United States Patent 12,747,451 (RNA ENCODING AN ANTIBODY) - sequence listing, part 6

SEQ ID NO: 28261 - RNA, 1428 nt, synthetic construct
  misc_feature 1..1428: note = derived and/or modified sequence opt3 from anti-influenza_Chain
  source 1..1428: mol_type = other RNA
atggagttcggcctgagctgggtgtttctcgtcgcccttctgagaggggttcagtgccaagtgcagttggtagaatccggaggtggcgtggtccagcccgggaggtctttacggctgtcatgtgctgcaagtggattcacctttagccgcttcggcatccactgggtgcgacaggcccctggtaaggggctagagtggatggcggttatttggtacgacggatccaacaaattttatgctgattctgtgaagggccgtttcacaatatcgagagacaattcaaagaacactgtctacctccaaatgaatagcctgagggccgaagatacggcagtgtattactgcgccaaggacagtcggggctattgttcctctatcatttgctttgaagggggacttgataactggggtcagggcaccctggtaacagttagctccgcttcaactaaagggccaagtgtgttcccgttggcacccagctctaagtccacctcaggaggcacagccgctctcggttgtctggtcaaggactactttcctgagccagtgaccgtgagctggaatagtggggccctgacttctggagtccatacattccccgcggttctccagtccagcggcttatattcgctgtcttccgtggtaaccgtgccttcaagtagccttggcacgcagacttacatctgcaacgtcaatcacaaaccatccaacaccaaggtggataaacgcgttgagcccaagtcttgtgacaaaacacatacttgccctccatgtccggcacccgagttgctcgggggacctagcgtgtttctattcccacccaagcctaaggataccctcatgatttcaagaacaccagaagtgacctgcgtcgtagttgacgtgagtcacgaggatcccgaagtcaaatttaattggtacgtggacggtgtcgaggtgcataacgccaagacgaaaccgagggaggaacaatataattccacttaccgggttgtgagcgtactgacagtccttcaccaggattggctgaacggcaaggagtataaatgtaaggtgtctaataaagccttgcctgctcccatcgaaaagaccatatcaaaggcaaaagggcagccacgcgagcctcaggtttacactctgcccccaagtcgagacgaactgacaaagaaccaagtgagcttaacctgcctggtcaaaggattctatccctccgacatcgctgtggagtgggagtctaatggccagcctgaaaacaactacaagacgaccccaccggtactcgattcggacggtagcttctttctttattccaaactgacagtggataagtcaagatggcagcaagggaatgttttcagttgctctgtcatgcacgagggcttgcataaccactacactcagaaaagcctatccctgtcacccggaaaa

SEQ ID NO: 28262 - RNA, 1428 nt, synthetic construct; identical to SEQ ID NO: 28261
  misc_feature 1..1428: note = derived and/or modified sequence opt3 from anti-influenza_Chain
  source 1..1428: mol_type = other RNA

SEQ ID NO: 28263 - RNA, 1428 nt, synthetic construct; identical to SEQ ID NO: 28261
  misc_feature 1..1428: note = derived and/or modified sequence opt3 from anti-influenza_Chain
  source 1..1428: mol_type = other RNA

SEQ ID NO: 28264 - RNA, 1440 nt, synthetic construct
  misc_feature 1..1440: note = derived and/or modified sequence opt3 from anti-influenza_Chain
  source 1..1440: mol_type = other RNA
atgcccagcgtgaagatcggcattataggggccggatccgctgtcttctctctgagactcgtttcagacctttgcaaaacccctggtctgagtggcagcacagtgactttgatggatatcgacgaggaaaggttagatgcaattctgacgatcgccaagaaatacgtagaggaagtgggggcggacctaaagtttgagaaaaccatgaacctcgatgacgtcattatcgatgctgacttcgtgataaatacagccatggttggaggccacacttatctggaaaaggtgcggcagatcggtgagaagtacgggtattaccgcggaattgatgcacaagagtttaacatggtctccgactattacaccttctctaattataaccagcttaaatactttgtggatatcgcccgaaagattgaaaaactgtcgccaaaggcttggtacttgcaggcagccaatccgatcttcgagggcacaaccctcgtaactcgtacagttcccataaaagctgtgggcttttgtcatgggcactatggagtcatggaaattgtggagaagctgggtctggaggaagagaaggtggactggcaggtcgccggcgttaaccatgggatctggctcaatagattcaggtacaacggaggcaatgcgtatcctttactggataaatggattgaagagaagtcaaaagactggaagccagaaaacccctttaatgaccaacttagccctgcagccatcgatatgtaccggttctatggtgtgatgccaatcggggacaccgtacgcaacagttcctggagataccacagggatttggagacgaaaaagaaatggtatggagagccctggggcggcgctgactctgaaattgggtggaagtggtaccaggatactctgggaaaggtgaccgagataactaaaaaggtcgccaaatttatcaaggaaaatcctagcgtgcggctatccgacctcggttcagttctgggcaaagatcttagtgagaagcagttcgtgctggaagtcgagaagattttggacccagagcgcaaaagcggggaacagcatatcccgtttatagatgcactcctgaacgacaataaggctcgattcgtggtaaacattcccaacaaaggaatcatccacggcattgatgacgacgttgtggtcgaggtgcctgccttagtcgataagaatggtatccacccagagaaaattgaaccccctctgccagacagagtggttaagtactatctcaggccccggataatgcgtatggaaatggcgcttgaggccttcctgacaggggatatccgcattatcaaggagttgctatacagagacccgaggaccaaatctgatgaacaagtggagaaggtaatcgaagagattctggcactccctgagaacgaagagatgcggaaacattatctgaagcga

SEQ ID NO: 28265 - RNA, 1440 nt, synthetic construct; identical to SEQ ID NO: 28264
  misc_feature 1..1440: note = derived and/or modified sequence opt3 from anti-influenza_Chain
  source 1..1440: mol_type = other RNA

SEQ ID NO: 28266 - RNA, 1443 nt, synthetic construct
  misc_feature 1..1443: note = derived and/or modified sequence opt3 from anti-influenza_Chain
  source 1..1443: mol_type = other RNA
atgaagttccccaaagactttatgatcggctacagctcctctcctttccagtttgaggccgggattccaggatcagaagatccgaacagtgactggtgggtgtgggtccacgatcccgagaataccgctgcaggtctggttagcggcgacttccctgaaaacgggccaggatattggaatctcaaccaaaatgatcatgaccttgccgagaagctgggcgtgaacacaataagagtaggtgtggaatggtccaggatctttcccaaacctactttcaatgtcaaggtgccagttgagcgggatgagaacgggtctattgtgcacgtcgacgtggatgacaaagcggtagaacgcttggatgagttagctaataaggaagccgttaaccattacgtggagatgtataaggactgggtcgagcgaggacgtaaactgatcctaaatctctaccactggcccctgcctctttggctgcataacccaattatggtgagaaggatgggcccggatcgggcaccctcgggctggttgaatgaagagtcagtggtcgaatttgccaagtatgctgcatacatcgcctggaaaatgggggagctccctgttatgtggagcacgatgaacgaaccaaatgtggtatatgagcagggatacatgttcgtgaagggtggctttccccctgggtacctgagtctggaggctgccgacaaagcgcgcagaaacatgatacaggcacacgccagggcttatgacaacatcaagcggttctccaagaaaccagtcggactcatttacgcctttcagtggttcgaattactggagggccccgcagaagtgtttgataagttcaaatctagcaaactttattacttcaccgacatcgtttccaagggttcaagtattatcaatgtggagtatcgccgagatttggctaacagactggactggctaggggtcaattactatagcaggctcgtgtacaagatagtagatgacaaaccgattatcctgcacggatacggctttctttgcacacctggcgggatttctcccgccgaaaacccatgttccgatttcggatgggaggtttatcctgagggtctgtacttgctcctgaaggaattatataatcggtacggcgtggacctgatcgtcactgagaacggggtgtcagatagccgtgacgcgctccgccccgcctatcttgtcagtcatgtgtactctgtttggaaggcagctaatgaaggaatcccagtgaaaggctatctgcactggtccttgaccgataactacgagtgggcccaaggttttagacagaagttcgggctagtaatggtcgactttaaaacaaagaaaaggtacctgcggcccagcgctctcgtgttccgagaaattgccacccataatggcatacctgacgagctgcagcaccttactctgatccag

SEQ ID NO: 28267 - RNA, 1443 nt, synthetic construct; identical to SEQ ID NO: 28266
  misc_feature 1..1443: note = derived and/or modified sequence opt3 from anti-influenza_Chain
  source 1..1443: mol_type = other RNA

SEQ ID NO: 28268 - RNA, 1464 nt, synthetic construct
  misc_feature 1..1464: note = derived and/or modified sequence opt3 from anti-influenza_Chain
  source 1..1464: mol_type = other RNA
cacgcccaggacatcctggagaagacccataacggcaaactctgcgatcttgacggggtgaagcccctgattttgagagattgtagcgtcgctggatggttactgggtaatcctatgtgcgacgagttcataaacgttccagaatggtcctacatcgtggaaaaagcaaatccggccaacgatctatgttatcccggcaattttaacgactacgaggaactcaagcatctgctttctaggattaatcacttcgagaaaatccaaattatccctaagtcaagttggagcgatcacgaggcgtcctctggggtatcgtcagcttgcccatatcagggaacacccagctttttccggaacgtggtctggctgataaagaaaaataacacttaccctacgatcaagcgcagttataataacaccaatcaggaagacttgctcattctgtggggcatccatcactccaacgatgccgcagagcagacaaaactgtaccaaaatccaactacctatatttctgtgggtacaagcaccctcaaccagcgattagttcccaagatcgccactcgttccaaagtgaacgggcagaatggaagaatggactttttctggacaatactgaagcctaacgatgctattaattttgaatcaaacggcaatttcatcgcaccagagtacgcctacaagattgtcaaaaagggctatatcccggaggctcccagggacgggcaggcctacgtgcggaaagatggagaatgggtacttttgagtacctttctgcgcagcgacaagacgcacacttgtcctccatgccccgcgcctgagctactcggtggcccatctgttttcctgtttcccccgaaacctaaggacacccttatgatctccagaacacccgaagtgacttgtgtcgtggtggatgtctcacatgaggacccagaagttaaattcaactggtatgtggatggggtagaggtgcacaatgcaaagaccaagcctagggaggaacaatacaacagcacatatcgggtcgtgagtgttctgaccgtgttgcatcaggactggctcaatggaaaagagtacaagtgcaaagtctctaacaaggccctgcccgctccaattgagaaaacgatatccaaggccaagggccagccccgcgaacctcaggtgtatactttaccaccgagccgagaagagatgaccaaaaatcaagtatcgctgacatgtctcgttaagggtttttacccctctgatatcgcagtggagtgggaatccaacgggcagcctgagaataactacaaaactacaccacccgtccttgactcagatggaagtttcttcctgtatagcaagttgaccgtggacaaatccagatggcagcaaggcaatgtcttttcttgcagcgtgatgcacgaagctctacacaaccattacacgcagaagtcactgagtctctcccctggcaag

SEQ ID NO: 28269 - RNA, 1464 nt, synthetic construct; identical to SEQ ID NO: 28268
  misc_feature 1..1464: note = derived and/or modified sequence opt3 from anti-influenza_Chain
  source 1..1464: mol_type = other RNA

SEQ ID NO: 28270 - RNA, 1473 nt, synthetic construct
  misc_feature 1..1473: note = derived and/or modified sequence opt3 from anti-influenza_Chain
  source 1..1473: mol_type = other RNA
atgctgagcttccccaagggctttaaattcgggtggtcccagtctggatttcaatcagagatgggtacccctggcagtgaagacccaaacagcgattggcacgtgtgggtccatgacagagagaatatcgtttcccaggtggtatctggggatctcccggaaaacggacccggctactggggtaattataagaggttccacgacgaggccgagaaaattgggcttaacgctgtgcggataaatgtcgagtggtcgcgcatctttcctcgaccactgcccaagcctgagatgcagacaggaactgataaagaaaactcaccagtgattagcgttgacttgaatgagagtaagttacgtgaaatggataactacgcaaatcatgaggccctgtcccactatagacagatcctagaggacctcaggaaccggggcttccatattgtgctgaatatgtaccactggacgcttcccatctggctgcacgatcctatacgcgtcagaaggggcgactttaccgggccaacaggatggttgaactctcggactgtgtatgagttcgcgcgctttagcgcttacgtagcctggaagctcgatgacctggcatccgaatatgccaccatgaatgaaccgaacgttgtgtggggtgctggctacgcattcccccgagccgggtttcctccaaattacctgtcattcagactcagtgagatcgctaaatggaacattatccaagcccatgcgagggcatatgatgccattaagagcgtctctaaaaagtccgtgggaatcatatacgctaacacatcatattaccccttacggcctcaggacaatgaagccgtggagattgcagagcgtctgaaccgctggagctttttcgacagtatcattaaaggcgaaatcacctctgagggtcagaatgtcagagaagatcttaggaaccggttggactggatcggggttaattattacactcgaacagtggtaaccaaggctgagtccggatatctgacgctaccaggctacggcgatcgctgcgaaagaaacagcctctcgctggccaatcttcccacttctgacttcgggtgggagtttttcccggagggactgtacgatgtgttgctcaagtattggaacaggtacggtctgcctttatatgtcatggaaaatggcattgcggacgatgccgactaccagcggccctattacctggtgtcccacatatatcaagttcatcgcgcactcaacgagggggtggatgtcagaggataccttcactggtcactggctgacaattacgaatggagtagcggcttttccatgaggttcggtttgctaaaagtggattatctgaccaagcgtctctactggcggccatctgccctggtatatcgagagatcacaagaagcaacgggattcctgaagaacttgagcacctgaatagggttcccccaatcaaacccttgcgccat

SEQ ID NO: 28271 - RNA, 1473 nt, synthetic construct; identical to SEQ ID NO: 28270
  misc_feature 1..1473: note = derived and/or modified sequence opt3 from anti-influenza_Chain
  source 1..1473: mol_type = other RNA

SEQ ID NO: 28272 - RNA, 1494 nt, synthetic construct
  misc_feature 1..1494: note = derived and/or modified sequence opt3 from anti-influenza_Chain
  source 1..1494: mol_type = other RNA
atggccagccagggcaccaagagatcctacgagcaaatggaaacagacggggagaggcagaacgctactgaaatccgggcatctgtgggaaaaatgattggtggcatagggcgcttctatatccagatgtgcacggagctgaagctctcagattacgaaggacgacttattcagaatagtctgaccatcgagcgtatggtcttgagcgcctttgacgagagaaggaacaaatatttagaagaacacccctccgcgggcaaggatcctaaaaagacaggtgggccaatttaccggcgcgttaatggaaagtggatgagagaactgatcctatatgacaaagaggagataaggcggatctggcgccaagctaacaatggcgatgacgccactgcaggcctcacccatatgatgatttggcactctaacctgaatgatgccacataccagcgaaccagagctcttgtgaggactgggatggacccgcggatgtgttcgctgatgcagggatcaacattgccccgtcgcagcggtgcagccggcgctgccgtaaagggggtgggaaccatggtcatggaactcgtgagaatgatcaaaaggggcattaacgatcggaatttctggcgaggtgagaacgggcgcaagacgagaatcgcgtatgaaaggatgtgcaatatactgaaaggaaagtttcagactgcagcccaaaaggctatgatggaccaggttcgggagagtcgcgatcctggcaacgccgagttcgaggacctgacctttctcgcaagatccgctttaattctgaggggctctgtggcccataaaagctgtcttccagcgtgcgtctacgggcccgccgtggcatccggatacgatttcgagcgtgaaggttattcattggtaggcatcgacccttttcggctgctacagaatagtcaggtttacagcctcattcgaccaaacgagaatcccgctcacaagtctcaactggtgtggatggcctgtcattccgctgccttcgaagaccttagagtcctgtcatttatcaaagggacaaaggtggtgcctaggggaaaattgagcactcgcggcgtccagatcgcaagtaacgagaacatggaaaccatggagtcttccacactcgagctgcggagcagatattgggccattaggacccgctcgggtgggaatacgaaccagcaacgagcttctgcgggccagatatccatccagccaactttctcagttcagcggaatttaccgtttgatcgtacaaccgtgatggcagccttcactggaaacacagaaggcagaaccagtgacatgaggacggagattatccgcatgatggaaagcgctcggcccgaggatgtatcctttcaagggagaggagtgttcgaactgtctgacgagaaggccgcaagccctatagtcccatcattcgatatgagtaatgagggttcctactttttcggcgacaacgccgaagagtatgataat

SEQ ID NO: 28273 - RNA, 1494 nt, synthetic construct
  misc_feature 1..1494: note = derived and/or modified sequence opt3 from anti-influenza_Chain
  source 1..1494: mol_type = other RNA
atggccagccagggcaccaagagatcctacgagcaaatggaaacagacggggagaggcagaacgctactgaaatccgggcatctgtgggaaaaatgattgatggtataggccgcttctatatccagatgtgcacggagctgaagctctcagactacgaagggcgacttattcagaatagtctgaccatcgagcgtatggtcttgagcgcctttgatgagagaaggaacaaatatttagaggaacacccctccgcgggaaaggaccctaaaaagacaggcggtccaatttacaagcgggttgatgggaaatggatgcgcgaactggtgctatatgacaaggaggagatcagaaggatatggcggcaagctaataacggagatgacgccactgcaggcctcacccatatgatgatctggcactctaatctgaacgatacaacctaccagcgcactcgagcccttgtaagaacaggcatggacccgaggatgtgttcgctgatgcaggggtcaaccttgccccggcgtagcggagctgccggtgcagctgtgaaaggcgtcgggacgatggtgatggaactcattcgcatgatcaagagaggaattaatgataggaacttctggcggggcgagaatggtcgaaaaactcgcagtgcctatgaaagaatgtgcaacatcctgaaggggaagtttcagaccgcggcacaaagggccatgatggaccaggttcgggagtcccgcaatcctggaaacgctgaaatagaggatctgattttcctcgccagatctgcattaatcctgaggggcagcgtggctcataaatcctgtcttccagcctgcgtctacggccccgcgattgcctcagggtacaattttgagaaggaaggatatagtttggtgggtatcgaccctttcaaactgctacagaacagccaggtatactctctcatccgtccaaatgagaaccccgcacacaagtcccaactggtttggatggcttgtaactcagccgcttttgaagaccttcgggtgctgagcttcattcgaggcacaaaagtcagtcctagagggaagttgtctactaggggagtgcagatagcctccaatgagaacatggataccatggaaagctcgacactcgagctgcgctctcggtattgggcaatcagaaccaggtccggcggtaatacgaaccagcaacgcgcctcagctgggcagattagtgtgcagccagcgtttagcgtccagcgaaatttaccgttcgacaaacccactatcatggcagcctttacaggcaacaccgagggacggacttccgatatgcgtgctgaaataattagaatgatggagggcgccaagcctgaagagatgtctttccaagggaggggagtttttgaactgagcgacgagaaggcaacaaatccaatcgtgccctcattcgatatgagtaacgagggttcctacttctttggcgacaatgccgaagagtatgataac

SEQ ID NO: 28274 - RNA, 1494 nt, synthetic construct
  misc_feature 1..1494: note = derived and/or modified sequence opt3 from anti-influenza_Chain
  source 1..1494: mol_type = other RNA
atggccagccagggcaccaagagatcctacgagcaaatggaaacagggggagagaggcagaacgctactgaaatccgggcatctgtgggtcgcatggtcggcgggattggacgattctatgttcagatgtgcacggagctgaaactctcagaccaggaaggccgtcttatacaaaatagtatcaccattgagagaatggtgctgagcgcctttgatgagaggcggaaccgctacttggaggaacacccctccgcgggtaaggaccctaaaaagacagggggaccaatctatagaaggcgggatggcaaatgggtacgcgaattaattctgtacgacaaggaggagatccgaagaatatggaggcaggctaataacggcgaagatgccactgcagggctaacccatatgatgatctggcactctaatctcaacgacgccacatatcagcggacccgtgctctggtgcgcactggaatggatccgagaatgtgttcgcttatgcagggttcaacactgcccaggcggagcggcgcagccggggctgccattaagggagtcggcaccatggtgatggagttgatccgaatgattaaacgcggtatcaatgacagaaacttctggaggggagataatgggcggcgcacgagaatagcgtacgaaaggatgtgcaacattctcaagggcaaatttcaaactgcagcccagcgtgctatgatggaccaggttcgggagagtcgaaatcctggcaacgccgaaatcgaggatctgattttcctggcaagatccgctctcatcttaagggggtctgtggcccataagagctgtctgccagcgtgcgtctatggacttgccgtggcatccggttacgactttgagcgcgaaggctactcattggtagggatcgatcccttccggctgctacagaatagtcaagtttttagcctcattagacctaacgagaatccagctcacaaatctcagctggtgtggatggcctgtcattccgctgccttcgaagaccttagggtcagctcatttatacgcggaacccgagtgatcccccggggccagctgagtacacgtggtgtgcaaattgcatctaacgagaacgtcgaagccatggactccagcactttggagctcagatcgaggtattgggctatccgcacccggtctgggggcaatacaaaccagcagagagcgtccgcaggacagatatcagttcaacctaccttcagtgtgcagaggaatctgccatttgagcgaccgacgattatggccgctttcaagggcaacactgaagggcgcacaagcgatatgcggaccgagatcatcagaatgatggaatccgccaggcccgaggacgtatcttttcagggacgtggtgtgttcgaattaagcgatgagaaggcaactaatcctattgtcccatcattcgacatgagtaacgagggctcctactttttcggggataatgccgaagagtatgacaac

SEQ ID NO: 28275 - RNA, 1494 nt, synthetic construct; identical to SEQ ID NO: 28272
  misc_feature 1..1494: note = derived and/or modified sequence opt3 from anti-influenza_Chain
  source 1..1494: mol_type = other RNA

SEQ ID NO: 28276 - RNA, 1494 nt, synthetic construct; identical to SEQ ID NO: 28273
  misc_feature 1..1494: note = derived and/or modified sequence opt3 from anti-influenza_Chain
  source 1..1494: mol_type = other RNA

SEQ ID NO: 28277 - RNA, 1494 nt, synthetic construct; identical to SEQ ID NO: 28274
  misc_feature 1..1494: note = derived and/or modified sequence opt3 from anti-influenza_Chain
  source 1..1494: mol_type = other RNA

SEQ ID NO: 28278 - RNA, 1530 nt, synthetic construct
  misc_feature 1..1530: note = derived and/or modified sequence opt3 from anti-influenza_Chain
  source 1..1530: mol_type = other RNA
atgttccccgagaagtttctgtggggcgtggcccagagcgggttccaatttgaaatgggagacaaactcagaaggaacatcgataccaatacagactggtggcactgggtccgggataagactaacattgagaaaggtcttgtttccggcgacctgcctgaagaggggataaataactacgaattgtatgagaaggatcatgagatcgctcgcaaattaggactgaatgcataccgaattggcatcgaatggtctcgtattttcccatggccgacgacctttatcgacgtggattattcatacaacgagagttataatctaatagaagacgtaaagatcacaaaggatactctcgaggagctggacgaaattgccaacaaaagagaggtggcgtactataggagcgtcatcaattcccttcggtctaagggtttcaaagtgattgttaacctgaatcactttaccttgccctactggctccatgatcctatcgaagctcgcgagagagccctgacaaacaagaggaatgggtgggtgaacccacggaccgtcatagaatttgcaaaatacgccgcttatattgcatacaagtttggagacatcgtggatatgtggtcgactttcaatgagcccatggtagttgtggagctgggctatctcgccccttactcaggctttccacccggggtcttaaaccctgaagctgccaagctggcgattcttcacatgatcaacgcacatgccttggcttatcgccagatcaaaaagttcgacacagagaaagccgacaaggatagcaaagaaccagcagaggtgggaattatatacaataacatcggtgtggcttatccgaaggaccccaatgatagtaaagacgtcaaggccgcggaaaacgataatttcttccactccggcctgttctttgaggccattcacaaggggaaactaaacatcgagttcgacggagaaacctttatagatgcaccttacctcaagggcaatgactggattggtgttaactactatacgcgagaggtggtaacttaccaggaaccaatgttcccctctatccctctgatcacctttaaaggggtgcagggatatggctacgcttgcagaccaggcacacttagcaaggatgacaggcccgtctccgatattgggtgggagctgtatccggaaggaatgtacgactcaatcgtggaggcccataaatatggtgttcctgtgtacgtcactgagaatggcattgctgacagtaaggatatattgcggccctactatatcgccagccacattaagatgaccgaaaaagcattcgaggacgggtacgaagtgaagggatattttcattgggccctcacagataacttcgagtgggctctgggctttcgtatgcgcttcggtttatacgaggtaaatctgatcaccaaagaaagaatcccaagggagaagtctgtttccatttttcgggaaatagtggcgaacaatggggtcacgaaaaagatcgaggaggaactccttcgaggc

SEQ ID NO: 28279 - RNA, 1530 nt, synthetic construct; identical to SEQ ID NO: 28278
  misc_feature 1..1530: note = derived and/or modified sequence opt3 from anti-influenza_Chain
  source 1..1530: mol_type = other RNA

SEQ ID NO: 28280 - RNA, 1536 nt, synthetic construct
  misc_feature 1..1536: note = derived and/or modified sequence opt3 from anti-influenza_Chain
  source 1..1536: mol_type = other RNA
atgaagagaaaagtgaagaaaatggccgctatggcaaccagcatcattatggccataatgatcattctgcactccatccccgtcctcgcgggcaggattatctacgacaacgagacagggactcatggaggttatgattacgaactttggaaggactatggcaatacgataatggagctgaacgatgggggaaccttctcttgccagtggtcaaatatcggcaacgctttgtttcggaaaggtcgcaagttcaatagtgacaagacataccaagaattaggggatattgttgtggagtatggatgtgactacaaccctaatggcaacagctatctgtgcgtatacggctggactcgaaatccgctagtggaatactatatcgtcgagtcctgggggtcttggcgtccacccggagccacccctaaaggtacaattacccagtggatggcaggcacttacgagatctatgaaacaaccagagtgaaccagccatcgatagatgggacggccacttttcagcaatactggtcagttaggaccagcaagcggacaagtggaactatttccgtgaccgagcacttcaaacagtgggaacgcatgggcatgagaatgggtaagatgtatgaggtcgctctcacagtggaggggtaccagtctagcggatatgcaaatgtatacaaaaacgaaatcaggattggcgccaatcccacccctgctccatcccagtcacccatccggcgcgacgcctttagtatcattgaggcggaagagtacaacagcactaattcttccacgctgcaagttataggcacacctaacaacgggcgaggaatcggttatattgaaaatggcaacaccgtgacttactcaaatatcgatttcgggagcggagcaacaggctttagtgccaccgtcgctacggaggtgaacacctctatacagattagatccgacagcccaacaggtactcttctggggaccttgtatgtgtcgtctacaggctcctggaatacttaccagaccgtctcaacaaacatcagtaagatcaccggagttcatgatattgtgctcgtattcagcggcccggtgaatgtcgacaactttatcttctccaggtctagccccgtgcctgccccaggggataatactcgggacgcatattcaattatacaggctgaggactacgatagttcctatggacccaacctgcaaatctttagcctgcctggtggcgggtctgccattggatacatcgaaaatggctactcaacgacatataagaacatcgacttcggtgatggggcgaccagtgttactgcccgtgtggcaacccagaatgctacaaccattcaggtccgcctcggcagcccatccggaactttactgggcacaatatacgtggggtctacgggatcgtttgacacctatagagatgtaagcgccactatctccaacacagctggtgttaaagacattgtgcttgtcttctcaggccccgtgaatgtcgattggttcgtgtttagtaagtctgggacc

SEQ ID NO: 28281 - RNA, 1536 nt, synthetic construct; identical to SEQ ID NO: 28280
  misc_feature 1..1536: note = derived and/or modified sequence opt3 from anti-influenza_Chain
  source 1..1536: mol_type = other RNA

SEQ ID NO: 28282 - RNA, 1539 nt, synthetic construct
  misc_feature 1..1539: note = derived and/or modified sequence opt3 from anti-influenza_Chain
  source 1..1539: mol_type = other RNA
atctgcattggctaccacgccaacaatagcaccgaacaggtggacacaataatggaaaagaacgtcactgttacgcatgctcaagatatcctggagaaaacccacaatgggaagctctgtgaccttgatggagtgaaacccctgattttgagagactgctccgtagcaggttggttactgggcaaccctatgtgtgatgagttcatcaatgtgccagagtggtcttatattgtcgaaaaggccaacccggcgaatgacctatgctaccccgggaactttaatgattatgaggagctcaaacatctgctttcaaggatcaaccacttcgaaaagatacagatcattcctaagagtagctggtccgaccatgaggcttcttcgggagtgtcaagcgcctgtccataccagggcacaccctcctttttccggaatgttgtgtggctgatcaaaaagaacaatacttatcctaccattaaacgcagttacaacaatacaaaccaggaagatttgctcatcctgtggggtatacaccactctaacgacgcagccgagcaaaccaagctgtatcagaatccaactacatacattagcgtcgggacctccacgctcaaccagcgattagtgcccaaaatcgctactcgttcaaaggtaaatggacagaacggcagaatggactttttctggaccattctgaagcctaatgatgcaatcaactttgagagtaatggcaacttcatcgccccagaatacgcttataaaattgttaagaaagggtacataccggaggcccccagggatggacaagcgtatgtgcggaaggacggtgaatgggtccttttgagcacatttctgcgctctgacaaaactcatacctgccctccatgtcccgcacctgagctactcggcgggccatccgtgttcctgtttcccccgaagcctaaagatacacttatgatctcaagaacccccgaagtgacgtgcgtcgttgtggacgtaagccacgaggatccagaggtgaagttcaattggtacgtcgacggagtggaagttcataacgccaagactaaacctagggaggaacagtataatagtacataccgggtggtctctgtgctgaccgtattgcaccaggattggctcaacggcaaggagtataaatgtaaggtttccaataaagctctgcccgccccaattgaaaagactatcagcaaggcaaaaggtcagccccgcgagcctcaagtgtacacattaccaccgtcgcgagaggaaatgaccaagaaccaggtctctctgacgtgcctcgtgaaagggttttacccctccgacatagctgtcgagtgggaatcaaatggacagcctgagaacaactataagaccacaccacccgtgcttgatagtgacggcagcttcttcctgtactccaaattgactgttgataagtctagatggcaacagggcaatgtgtttagctgttcagtaatgcacgaagccctacataaccactatacccagaagagtctgtccctcagccctgggaaa

SEQ ID NO: 28283 - RNA, 1539 nt, synthetic construct; identical to SEQ ID NO: 28282
  misc_feature 1..1539: note = derived and/or modified sequence opt3 from anti-influenza_Chain
  source 1..1539: mol_type = other RNA

SEQ ID NO: 28284 - RNA, 1593 nt, synthetic construct
  misc_feature 1..1593: note = derived and/or modified sequence opt3 from anti-influenza_Chain
  source 1..1593: mol_type = other RNA
accctgtgcatcggctaccacgccaacaatagcacagacactgtggatacggtcctcgagaagaacgttaccgtgacacattccgtaaatcttctggaagacaaacacaacgggaagttgtgtaaattaagaggagtggctcccctgcatctaggtaagtgcaatattgcaggctggatactcgggaaccctgagtgtgaatctctgtcaactgccagtagctggtcctatatcgtcgagacctcttcgtcagataatggaacatgctacccaggcgacttcattgattatgaggagcttagggagcagctgagcagtgtgtcctcttttgaacggttcgagatctttccgaaaaccagctcctggcccaaccacgactcaaataagggtgttactgcggcttgtcctcatgccggggcaaagagtttctacaaaaacttgatttggctcgtgaagaaaggaaatagctatccaaagctgtctaaatcctacatcaacgataagggcaaggaagtcctggtgctctggggcatacaccacccctcaacaagcgccgaccaacagagtttatatcagaatgctgatgcatacgtatttgttgggacctctcgctactccaaaaagttcaaacctgagatcgccattcgaccaaaggtgcgtgaccaggagggaagaatgaactattactggacgctggtcgaacccggtgataaaatcacttttgaggctaccggcaatcttgtggtgcctaggtatgccttcgcgatggaacgggacgcagggagcggaattatcatatcggatacaccagtccatgactgcaacactacctgtcaaacaccgaagggcgccattaacacctctttgccctttcagaatatccaccctattacgatcggtaaatgcccaaagtacgttaagtccactaaactgcgcctagctacagggctcagaaacgtgccctcaatccagagtaggggactgttcggcgccattgcaggctttatagaagggggatggaccggtatggtagacggctggtatgggtaccatcaccagaatgaacaaggaagcggctatgctgccgatcttaagtccactcagaacgcgatcgacgagattacaaataaagtgaactctgtcatcgagaagatgaatacccagttcacggccgtgggtaaagaatttaaccacctggagaagcggatagaaaatttgaacaagaaaattgatgacgggttcctcgatatctggacctacaatgcagagctgttagttctgctcgaaaacgagcgcacacttgactaccatgatagcaatgtgaagaacctgtatgagaaagtccgatcacagttgaagaataacgctaaagaaatcggcaacggatgtttcgagttttaccacaagtgcgacaatacttgtatggaaagtgtgaagaacggcacctatgattaccctaaatattccgaggaagccaagctaaatagagaggagattgacggggtaaaactggaaagcacaaggatctaccaaattctcgctatatattctactgttgcctcaagtctggtgcttgtcgtgagcctgggagca

SEQ ID NO: 28285 - RNA, 1593 nt, synthetic construct
  misc_feature 1..1593: note = derived and/or modified sequence opt3 from anti-influenza_Chain
  source 1..1593: mol_type = other RNA
accctgtgcatcggctaccacgccaacaatagcacagacactgtggatacggtcctcgagaagaacgttaccgtgacacattccgtaaatcttctggaagacaaacacaacgggaagttgtgtaaattaagaggagtggctcccctgcatctaggtaagtgcaatattgcaggctggatactcgggaaccctgagtgtgaatctctgtcaactgccagtagctggtcctgcatcgtcgagacctcttcgtcagataatggaacatgttatccaggcgacttcattgattacgaggagcttagggagcagctgagcagtgtgtcctcttttgaacggttcgagatctttccgaaaaccagctcctggcccaaccacgactcaaataagggtgttactgcggcttgccctcatgccggggcaaagagtttctataaaaacttgatttggctcgtgaagaaaggaaatagctacccaaagctgtctaaatcctatatcaacgataagggcaaggaagtcctggtgctctggggcatacaccacccctcaacaagcgccgaccaacagagtttataccagaatgctgatgcatatgtatttgttgggacctctcgctactccaaaaagttcaaacctgagatcgccattcgaccaaaggtgcgtgaccaggagggaagaatgaactactattggacgctggtcgaacccggtgataaaatcacttttgaggctaccggcaatcttgtggtgcctaggtacgccttcgcgatggaacgggacgcagggagcggaattatcatatcggatacaccagtccatgactgtaacactacctgccaaacaccgaagggcgccattaacacctctttgccctttcagaatatccaccctattacgatcggtaaatgtccaaagtatgttaagtccactaaactgcgcctagctacagggctcagaaacgtgccctcaatccagagtaggggactgttcggcgccattgcaggctttatagaagggggatggaccggtatggtagacggctggtacgggtatcatcaccagaatgaacaaggaagcggctacgctgccgatcttaagtccactcagaacgcgatcgacgagattacaaataaagtgaactctgtcatcgagaagatgaatacccagttcacggccgtgggtaaagaatttaaccacctggagaagcggatagaaaatttgaacaagaaaattgatgacgggttcctcgatatctggacctataatgcagagctgttagttctgctcgaaaacgagcgcacacttgactaccatgatagcaatgtgaagaacctgtacgagaaagtccgatcacagttgaagaataacgctaaagaaatcggcaacggatgcttcgagttttatcacaagtgtgacaatacttgcatggaaagtgtgaagaacggcacctacgattatcctaaatactccgaggaagccaagctaaatagagaggagattgacggggtaaaactggaaagcacaaggatctatcaaattctcgctatatactctactgttgcctcaagtctggtgcttgtcgtgagcctgggagca

SEQ ID NO: 28286 - RNA, 1593 nt, synthetic construct
  misc_feature 1..1593: note = derived and/or modified sequence opt3 from anti-influenza_Chain
  source 1..1593: mol_type = other RNA
accctgtgcatcggctaccacgccaacaatagcacagacactgtggatacggtcctcgagaagaacgttaccgtgacacattccgtaaatcttctggaagacaaacacaacgggaagttgtgtaaattaagaggagtggctcccctgcatctaggtaagtgcaatattgcaggctggatactcgggaaccctgagtgtgaatctctgtcaactgccagtagctggtcctatatcgtcgagacctcttcgtcagataatggaacatgctacccaggcgacttcattgattatgaggagcttagggagcagctgagcagtgtgtcctcttttgaacggttcgagatctttccgaacaccagctcctggcccaatcacgactcaaacaaaggtgttactgcggcttgtcctcatgccggggcaaagagtttctacaagaatttgatttggctcgtgaaaaagggaaacagctatccaaaactgtctaagtcctacatcaatgataaaggcaaggaagtcctggtgctctggggcatacaccacccctcaacaagcgccgaccaacagagtttatatcagaacgctgatgcatacgtatttgttgggacctctcgctactccaagaaattcaagcctgagatcgccattcgaccaaaagtgcgtgaccaggagggaagaatgaattattactggacgctggtcgaacccggtgataagatcacttttgaggctaccggcaaccttgtggtgcctaggtatgccttcgcgatggaacgggacgcagggagcggaattatcatatcggatacaccagtccatgactgcaacactacctgtcaaacaccgaaaggcgccattaatacctctttgccctttcagaacatccaccctattacgatcggtaagtgcccaaaatacgttaagtccactaagctgcgcctagctacagggctcagaaatgtgccctcaatccagagtaggggactgttcggcgccattgcaggctttatagaagggggatggaccggtatggtagacggctggtatgggtaccatcaccagaacgaacaaggaagcggctatgctgccgatcttaaatccactcagaatgcgatcgacgagattacaaacaaggtcaattctgtgatcgagaaaatgaacacccagttcacggccgtgggtaaggaatttaatcacctggagaaacggatagaaaacttgaataagaagattgatgacgggttcctcgatatctggacctacaacgcagagctgttagttctgctcgaaaatgagcgcacacttgactaccatgatagcaacgtgaaaaatctgtatgagaaggtccgatcacagttgaaaaacaacgctaaggaaatcggcaatggatgtttcgagttttaccacaaatgcgacaacacttgtatggaaagtgtgaagaatggcacctatgattaccctaagtattccgaggaagccaaactaaacagagaggagattgacggggtaaagctggaaagcacaaggatctaccaaattctcgctatatattctactgttgcctcaagtctggtgcttgtcgtgagcctgggagca

SEQ ID NO: 28287 - RNA, 1593 nt, synthetic construct
  misc_feature 1..1593: note = derived and/or modified sequence opt3 from anti-influenza_Chain
  source 1..1593: mol_type = other RNA
accctgtgcatcggctaccacgccaacaatagcacagacactgtggatacggtcctcgagaagaacgttaccgtgacacattccgtaaatcttctggaagacaaacacaacgggaagttgtgtaaattaagaggagtggctcccctgcatctaggtaagtgcaatattgcaggctggatactcgggaaccctgagtgtgaatctctgtcaactgccagtagctggtcctatatcgtcgagacctcttcgtcagataatggaacatgctacccaggcgacttcattgattatgaggaacttagggagcagctgagcagtgtgtcctcttttgaacggttcgagatctttccgaaaaccagctcctggcccaaccacgactcaaataagggtgttactgcggcttgtcctcatgccggggcaaagagtttctacaaaaacttgatttggctcgtgaagaaaggaaatagctatccaaagctgtctaaatcctacatcaacgataagggcaaggaagtcctggtgctctggggcatacaccacccctcaacaagcgccgaccaacagagtttatatcagaatgctgatgcatacgtatttgttgggacctctcgctactccaaaaagttcggacctgagatcgccattcgaccaaaagtgcgtgaccaggagggtagaatgaactattactggacgctggtcgaacccggcgataagatcacttttgaggctaccgggaatcttgtggtgcctaggtatgccttcgcgatggaacgggacgcaggaagcggcattatcatatcggatacaccagtccatgactgcaacactacctgtcaaacaccgaaaggtgccattaacacctctttgccctttcagaatatccaccctattacgatcgggaagtgcccaaaatacgttaagtccactaagctgcgcctagctacaggactcagaaacgtgccctcaatccagagtaggggcctgttcggcgccattgcagggtttatagagggaggttggaccggcatggtagacgggtggtatggataccatcaccagaatgaacaaggcagcggttatgctgccgatcttaaatccactcagaacgcgatcgacgagattacaaataaggtgaactctgtcatcgagaaaatgaatacccagttcacggccgtggggaaggaatttaaccacctggagaaacggatagaaaatttgaacaagaagattgatgacggcttcctcgatatctggacctacaatgcagagctgttagttctgctcgaaaacgagcgcacacttgactaccatgatagcaatgtgaaaaacctgtatgagaaggtccgatcacagttgaaaaataacgctaaggaaatcggaaacggctgtttcgagttttaccacaaatgcgacaatacttgtatggaaagtgtgaagaacgggacctatgattaccctaagtattccgaggaagccaaactaaatagagaggagattgacggagtaaagctggaaagcacaaggatctaccaaattctcgctatatattctactgttgcctcaagtctggtgcttgtcgtgagcctgggtgca

SEQ ID NO: 28288 - RNA, 1593 nt, synthetic construct; identical to SEQ ID NO: 28284
  misc_feature 1..1593: note = derived and/or modified sequence opt3 from anti-influenza_Chain
  source 1..1593: mol_type = other RNA

SEQ ID NO: 28289 - RNA, 1593 nt, synthetic construct; identical to SEQ ID NO: 28285
  misc_feature 1..1593: note = derived and/or modified sequence opt3 from anti-influenza_Chain
  source 1..1593: mol_type = other RNA

SEQ ID NO: 28290 - RNA, 1593 nt, synthetic construct; identical to SEQ ID NO: 28286
  misc_feature 1..1593: note = derived and/or modified sequence opt3 from anti-influenza_Chain
  source 1..1593: mol_type = other RNA

SEQ ID NO: 28291 - RNA, 1593 nt, synthetic construct; identical to SEQ ID NO: 28287
  misc_feature 1..1593: note = derived and/or modified sequence opt3 from anti-influenza_Chain
  source 1..1593: mol_type = other RNA

SEQ ID NO: 28292 - RNA, 1605 nt, synthetic construct
  misc_feature 1..1605: note = derived and/or modified sequence opt3 from anti-influenza_Chain
  source 1..1605: mol_type = other RNA
gccaacgctgacaccctgtgcatcggctaccacgcaaataacagcacagatactgtggacacggtcctcgagaagaatgttaccgtgacacattccgtaaaccttctggaagataaacacaatgggaagttgtgtaaattaagaggagtggcgcccctgcatctaggtaagtgcaacattgccggctggatactcgggaatcctgagtgtgaatctctgtcaactgctagtagctggtcctatatcgtcgagacctcttcgtcagacaacggaacatgctacccaggcgatttcattgactatgaggagcttagggagcagctgagcagtgtgtcctcttttgaacggttcgagatctttccgaaaaccagctcctggcccgatcacgactcaaataagggtgttactgccgcatgtcctcatgccggggctaagagtttctacaaaaacttgatttggctcgtgaagaaaggaaatagctatccaaagctgtctaaatcctacatcaacgataagggcaaggaagtcctggtgctctggggcatacaccacccctcaacaagcgcagaccaacagagtttatatcagaatgccgatgcttacgtatttgttgggacctctcgctactccaaaaagttcaaacctgagatcgccattcgaccaaaggtgcgtgaccaggagggaagaatgaactattactggacgctggtcgaacccggtgataaaatcacttttgaggcgaccggcaatcttgtggtgcctaggtatgcattcgccatggaacggaacgctgggagcggaattatcatatcggacacaccagtccatgactgcaacactacctgtcaaacaccgaagggcgccattaatacctctttgccctttcagaacatccaccctattacgatcggtaaatgcccaaagtacgttaagtccactaaactgcgcctagcaacagggctcagaaatgtgccctcaatccagagtaggggactgttcggcgctattgccggctttatagaagggggatggaccggtatggtagatggctggtatgggtaccatcaccagaacgaacaaggaagcggctatgcggccgaccttaagtccactcagaatgcaatcgataaaattacaaacaaggtaaattctgtcatcgagaaaatgaacacccagttcacggctgtgggtaaggagtttaatcacctggaaaagcggatagagaacttgaataaaaaggttgacgatgggttcctcgacatttggacctacaacgccgaactgttagtgctgctcgagaatgaacgcacacttgattaccatgacagcaacgtcaaaaatctgtatgagaaggtgcgatcacagttgaaaaacaacgctaaggagatcggcaatggatgtttcgaattttaccacaagtgcgataacacttgtatggagagtgtgaaaaatggcacctatgactaccctaagtattccgaagaggccaaactaaacagagaagagatcgatggggttaagctggagagcacaaggatttaccaaatcctcgcaatttattctactgtggcctcaagtctggtccttgtggtcagcctgggagct

SEQ ID NO: 28293 - RNA, 1605 nt, synthetic construct
  misc_feature 1..1605: note = derived and/or modified sequence opt3 from anti-influenza_Chain
  source 1..1605: mol_type = other RNA
gccaacgctgacaccctgtgcatcggctaccacgcaaataacagcacagatactgtggacacggtcctcgagaagaatgttaccgtgacacattccgtaaaccttctggaagataaacacaatgggaagttgtgtaaattaagaggagtggcgcccctgcatctaggtaagtgcaacattgccggctggatactcgggaatcctgagtgtgaatctctgtcaactgctagtagctggtcctatatcgtcgagacctcttcgtcagacaacggaacatgctacccaggcgatttcattgactatgaggaacttagggagcagctgagcagtgtgtcctcttttgaacggttcgagatctttccgaaaaccagctcctggcccaatcacgattcaaacaagggtgttactgccgcatgtcctcgcgccggggctaagggattctacaaaaatttgatttggctcgtgaagaaaggcaacagttatccaaagctgaataaaagctacatcaacgacaagggcaaggaagtcctggtgctctgggggatacatcacccctctacaaccgcagatcaacagtccttatatcagaatgccgacacgtacgtatttgttggaacttcacgatacagcaaaaagttcaaacctgagatcgagattcgtccaaaggtgagagatcaggaaggtaggatgaactattactggaccctggtcgagcccggcgacaaaatcacatttgaagctactgggaaccttgtggtgcctcggtatgccttcgcgatggagcgcaatgcaggaagtggcattatcatatctgataccccagtccacgactgcaacacaacctgtcaaacgccgaagggtgccattaatacttccttgccctttcagaacatccatcctattacaatcgggaaatgcccaaagtacgttaagagcaccaaactgagactagctactggactcaggaatgtgccctcgatccagtctcggggcctgttcggcgccattgcagggtttatagaaggaggttggacaggcatggtagacgggtggtatggataccaccatcagaacgagcaaggctccggttatgctgccgatcttaagtcaacccagaatgcgatcgacaaaattacgaacaaggtgaatagtgtcatcgagaaaatgaacacccagttcacagccgtggataaggaatttaatcacctggagaagcgcatagaaaacttgaataaaaaggttgacgatgggttcctcgacatttggacttacaacgcagagctgttagtgctgctcgaaaatgagcgaacccttgattaccacgacagcaacgtcaaaaacctgtatgagaaggtgagaaatcagttgaaaaacaatgctaaggaaatcggcaacggatgtttcgagttttaccataagtgcgataatacatgtatggaatccgttaaaaacggcacttatgactaccctaagtattctgaggaagccaaactaaatagggaggagatcgatggggtaaagctggaaagcacccggatttaccaaatcctcgctatttattcaacagtggccagttccctggtccttgtggtcagcctgggagca

SEQ ID NO: 28294 - RNA, 1605 nt, synthetic construct; identical to SEQ ID NO: 28292
  misc_feature 1..1605: note = derived and/or modified sequence opt3 from anti-influenza_Chain
  source 1..1605: mol_type = other RNA

SEQ ID NO: 28295 - RNA, 1605 nt, synthetic construct; identical to SEQ ID NO: 28293
  misc_feature 1..1605: note = derived and/or modified sequence opt3 from anti-influenza_Chain
  source 1..1605: mol_type = other RNA

SEQ ID NO: 28296 - RNA, 1644 nt, synthetic construct
  misc_feature 1..1644: note = derived and/or modified sequence opt3 from anti-influenza_Chain
  source 1..1644: mol_type = other RNA
cagaagctgcccggcaacgacaatagcaccgccacactctgccttgggcaccatgctgtgcctaacggaactatcgtcaaaacgattaccaatgatcaaatagaggttacaaacgcaactgaactggtgcagtcctcttcaaccggtgagatctgtgacagtccacaccagattttggatggcgaaaattgcacattaatcgacgccctgctaggggatccgcagtgtgacggattccaaaacaagaaatgggatctctttgtagagagaagcaaggcgtactccaattgctatccctacgacgtgcctgattatgcttctctgaggtcgcttgtcgcctcaagcggcaccctggagttcaacaatgaaagttttaactggactggtgtgacacagaatgggacctcctctgcatgtattcggcgcagcaacaattccttcttttcacgattgaactggctcacgcatctgaaattcaagtacccagccctgaatgttactatgcccaacaacgagaagtttgacaaactctatatctggggagtgcaccatcctggcaccgataatgaccagatattcccatacgctcaggcaagtggccgtatcacagtcagcactaagagatctcaacagaccgtgattcccaacatcgggtccaggcctcgggtacgcaatattccatcaagaatcagcatatattggacaattgttaaaccgggagatatcttactgattaacagtaccggtaatcttatcgcccccaggggctactttaagatccggtctgggaaatccagcattatgcgctcggacgctcctataggaaagtgcaactctgaatgtatcacgccaaatggctccattcccaacgacaagcctttccagaatgtgaaccgaatcacttacggtgcctgcccaagatatgtcaaacagaatacattgaagctggcgaccgggatgaggaacgtgcccgagaaacaaactcggggaatatttggcgcaattgccggcttcatcgaaaatgggtgggagggaatggtggatggttggtacggctttcgtcaccagaactcagaggggatcggacaggctgccgacctaaagagtacacaagcagctattgatcagatcaatggcaaactcaaccgcctgattggtaagaccaacgaaaaattccaccagatagagaaggagttcagcgaagtcgaagggagaatccaggaccttgagaagtatgttgaggatacgaaaattgacctgtggtcctacaatgccgaattgctcgtggcgctggagaaccaacataccatcgatttaacagactctgaaatgaataagctgtttgagaaaactaagaaacagctcagggaaaacgccgaggatatgggcaatggatgtttcaagatctatcacaagtgcgacaacgcatgtattggcagcatacggaatgggacctacgatcatgacgtatatcgagacgaggctcttaacaatcgctttcagatcaaaggagtggaactgaagtcaggttacaaagattggattttgtggatcagtttcgccatttcctgctttctactgtgcgtcgctctcctgggcttcatcatgtgggcctgtcagaaggggaacataagatgcaatatc

SEQ ID NO: 28297 - RNA, 1644 nt, synthetic construct; identical to SEQ ID NO: 28296
  misc_feature 1..1644: note = derived and/or modified sequence opt3 from anti-influenza_Chain
  source 1..1644: mol_type = other RNA

SEQ ID NO: 28298 - RNA, 1647 nt, synthetic construct
  misc_feature 1..1647: note = derived and/or modified sequence opt3 from anti-influenza_Chain
  source 1..1647: mol_type = other RNA
atgctgaccttccacagaatcattaggaagggctggatgtttctccttgccttcctgttgacagctttactgttttgccccactgggcagcctgcaaaagccgcggctccattcaacggaacgatgatgcaatactttgagtggtatctaccggacgatggtaccctctggacaaaggtggccaatgaagcaaacaatctgagctcccttggcataactgccctgtggttgccccctgcttacaaagggacctctcggtcagacgtcggatatggcgtttacgatctctatgacctgggtgagttcaaccagaagggggcagtgcgcacaaaatacggaaccaaggcccagtatctgcaggctatccaagccgcgcatgcagccggcatgcaggtatacgctgatgtggtctttgaccacaagggcggggccgatggaactgaatgggtggacgcagttgaggtgaatccaagtgatcgaaaccaggaaattagcggtacataccagatccaggcttggaccaaattcgactttcccggccgtgggaatacgtattcctctttcaagtggagatggtaccattttgatggagtcgactgggatgagtcgaggaaactctcacggatttataagttccgcggcatcggtaaagcctgggactgggaggtggacactgaaaacgggaattacgattatttaatgtacgcggacctggatatggaccaccctgaggtagttaccgaacttaagagctggggaaagtggtatgtgaacacaactaatatagatggctttagattggacgccgtcaaacatatcaagttcagtttctttccagattggctgtccgacgtgaggtctcaaaccggcaaacccctattcacagtgggggagtactggagctacgatattaacaagctccacaattatatcatgaaaaccaacggaacgatgtccctgtttgacgcacctcttcacaataagttctacactgcttcaaaaagtggtggcacatttgatatgcggaccctgatgactaacacattgatgaaggaccagccaaccctcgccgtcacgttcgttgacaaccatgataccgagccggggcaggctctgcaaagctgggtggacccctggtttaagcctttagcctatgcattcattctgacacgccaggaaggatacccatgtgtattttatggcgattactatggtatcccccagtacaatataccttctctcaaatccaagattgacccacttctgatcgcccgaagagattacgcttatgggactcaacacgactacttggatcattcagacattatcggctggaccagggagggagtgacagaaaaacccggcagcgggctagcggcactgatcactgatggaccgggtggcagtaagtggatgtatgtcgggaaacagcacgccggaaaggtgttctacgacctcaccggcaaccggtctgatacagttaccattaattccgacggttggggcgagtttaaggtgaacgggggaagcgtctcggtgtgggtacctcgtaaaactacggtttctacaatagcttggtccatcaccactcgcccctggaccgatgagttcgtgagatggacagaaccaaggctggtcgcctggcct

SEQ ID NO: 28299 - RNA, 1647 nt, synthetic construct
  misc_feature 1..1647: note = derived and/or modified sequence opt3 from anti-influenza_Chain
  source 1..1647: mol_type = other RNA
atctgcattggctaccacgccaacaatagcaccgaacaggtggacacaataatggaaaagaacgtcactgttacgcatgctcaagatatcctggagaaaacccacaatgggaagctctgtgaccttgatggagtgaaacccctgattttgagagactgctccgtagcaggttggttactgggcaaccctatgtgtgatgaatttatcaatgtgccagagtggtcttatattgtcgaaaaggccaacccggcgaatgacctatgctaccccgggaactttaatgattatgaggagctcaaacatctgctttcaaggatcaaccacttcgaaaagatacagatcattcctaagagtagctggtccgaccatgaggcttcttcgggagtgtcaagcgcctgtccataccagggcacacccagtttcttccggaatgttgtgtggctgatcaaaaagaacaatacttatcctaccattaaacgctcctacaacaatacaaaccaggaagatttgctcatcctgtggggtatacaccactctaacgacgcagccgagcaaaccaagctgtatcagaatccaactacatacattagcgtcgggacctccacgctcaaccagcgattagtgcccaaaatcgctactcgttcaaaggtaaatggacagaacggcagaatggactttttctggaccattctgaagcctaatgatgcaatcaactttgagagtaatggcaacttcatcgccccagaatacgcttataaaattgttaagaaaggggatagcgccatagtgaagtctgaggtcgaatacggaaattgcaacacaaaatgtcaaactccgatcggtgcgattaattcctcaatgccctttcataacatccaccctcttaccataggcgagtgcccaaagtatgtgaaaagcaataagttggtgctggcaacagggctaaggaacagtcccctccggtctgacaagacccatacgtgtcctccatgccccgccccggaactgcttggaggcccttccgtcttcctgtttcccccaaaacctaaggacactttgatgattagccgcacacccgaggttacctgtgtggtagtggatgtctcgcacgaggacccagaagtgaaattcaattggtacgttgatggtgtggaggtccacaacgctaagactaaacccagagaggagcagtataactctacatacagggtggtatccgttctcaccgtgctgcatcaggactggttaaatgggaaggaatataagtgcaaagtctcaaacaaggccctgcctgcaccaatcgagaaaacgatcagtaaggctaaaggacagccgcgggagccccaagtgtacaccctccctccaagccgcgaagagatgacaaagaatcaggtctcccttacttgcctggtgaagggcttttacccctctgatattgccgttgaatgggagagcaacggccagcctgaaaataactataaaaccacaccacccgtgttggactcagatgggagtttcttcctatactccaagctgactgtagacaaaagccgatggcaacagggaaatgtcttttcttgttcagtgatgcacgaggcgctccataaccactatacccagaagagtctgagcctttccccgggtaaa

SEQ ID NO: 28300 - RNA, 1647 nt, synthetic construct; identical to SEQ ID NO: 28299
  misc_feature 1..1647: note = derived and/or modified sequence opt3 from anti-influenza_Chain
  source 1..1647: mol_type = other RNA

SEQ ID NO: 28301 - RNA, 1647 nt, synthetic construct; identical to SEQ ID NO: 28298
  misc_feature 1..1647: note = derived and/or modified sequence opt3 from anti-influenza_Chain
  source 1..1647: mol_type = other RNA

SEQ ID NO: 28302 - RNA, 1650 nt, synthetic construct
  misc_feature 1..1650: note = derived and/or modified sequence opt3 from anti-influenza_Chain
  source 1..1650: mol_type = other RNA
gaccagatctgcattggctaccacgccaacaatagcaccgagcaagtggatacaataatggaaaagaacgtcactgttacgcatgctcaggacatcctggagaaaacccacaatgggaagctctgtgatcttgacggagtgaaacccctgattttgagagattgctccgtagcaggttggttactgggcaaccctatgtgtgacgaatttatcaatgtgccagagtggtcttatattgtcgaaaaggccaacccgacaaatgatctatgctaccccgggtcatttaacgactatgaggagctcaaacatctgcttagtaggatcaatcacttcgaaaagatacagatcattcctaagagctcctggtctgatcatgaggcgtcgtcaggagtgagcagtgcttgtccatacctgggctccccctctttcttccggaacgttgtgtggttgatcaaaaagaatagcacttatcctaccattaaaaagtcctacaacaatacaaaccaggaagacctcctggtcctgtggggtatccaccacccaaatgatgccgcagagcaaacccgcctctatcagaaccccactacatacatatcaattgggaccagtacgttaaaccagcgactggtgcctaaaatcgccactcgtagcaaggtaaatggacagtctggcagaatggagtttttctgggctattcttaagccaaacgacgcaatcaattttgaatccaacggcaatttcatcgccccggagtacgcttataaaattgttaagaaaggggattcagccataatgaaaagcgaattggagtacggaaactgcaataccaagtgtcaaacacccatgggtgcgatcaacagttctatgccttttcataatattcacccactgactatcggcgaatgccccaagtatgtgaaatccaacaggctagtcctcgcaaccgggctgcggaatagccctcagcgcgagtcgagaaggaagaagcggggacttttcggcgccatagctggttttattgaagggggatggcagggcatggtggacggctggtacgggtatcatcactctaacgaacagggatccggttacgccgcagacaaagagtcaacacaaaaggctatcggcgtgaccaataaagtcaacagtatcattgataagatgaatacgcagttcgaagccgttgggcgcgagtttaacaacctggaacgaagaatcgagaatttgaacaaaaagatggaggacggattcctcgatgtgtggacttataatgcggaactgttagtactgatggagaacgaaaggacactcgacttccacgatagcaatgtgaagaacctttacgacaaagtccggctgcagttgcgtgataatgccaaggagctaggcaacggttgttttgagttctaccataaatgcgacaatgagtgtatggagtccattcgcaacgggacctataatccacaatactctgaagaggcaagactgaagagggaagagataagcggcgtgaaactcgagtcaatcggaacttatcagattctgagtatctactccacagttgctagctctcttgccctggctatcatgattgccggcttgtcactctggatgtgcagtaacgggagcctgcagtgccggatatgtatc

SEQ ID NO: 28303 - RNA, 1650 nt, synthetic construct; identical to SEQ ID NO: 28302
  misc_feature 1..1650: note = derived and/or modified sequence opt3 from anti-influenza_Chain
  source 1..1650: mol_type = other RNA

SEQ ID NO: 28304 - RNA, 1656 nt, synthetic construct
  misc_feature 1..1656: note = derived and/or modified sequence opt3 from anti-influenza_Chain
  source 1..1656: mol_type = other RNA
atgaacatccagattctggccttcatagcttgcgtgctcaccggcgcaaagggggacaaaatctgtcttggacaccatgccgtcgcgaatggtacaaaggttaacactctgacggagaaaggcattgaagtggtaaatgctaccgagacagtggaaactgccgatgtcaagaaaatctgcacccaagggaagagagcaacagacttgggaaggtgtggcttactgggtaccctaattgggccccctcagtgcgatcagtttctcgagttcagctccgacctgatcatagaacggcgcgagggaactgatgtgtgttacccaggccgatttacaaacgaggaatctcttcgtcagatcctgagaaggtcaggcgggattggaaaggagagtatgggtttcacctatagcggcatccggacgaatggggccgcttccgcatgcactcgctctggatcgtcattttacgccgaaatgaaatggttgctcagcaacagtgacaattccgctttcccgcaaatgaccaaggcctatagaaaccccaggaataaacctgcgctgattatctggggcgttcaccattctgagagcgcatccgagcagacaaagctgtacggttcagggaacaaactcataactgtgcggagtagcaagtatcagcagtcttttaccccatcccccggaacacgccgaattgatttccactggttactgcttgaccctaatgataccgtcacgtttactttcaacggcgcctttatcgctccagacagagcctcattctttaggggcgagagcttgggggtgcaaagtgatgcacccctggactcttcctgtcggggagattgcttccatagcggtggcacaattgtatcgtctctacctttccagaatatcaactcccgtaccgttgggcgctgtccaagatacgtgaagcagaaatcactcctgcttgctactggaatgaggaatgtcccggaaaagcccaaacctcggggcctgtttggtgccatcgcggggttcattgaaaacggctgggagggattgataaacggctggtatgggtttcgacaccagaatgcccaaggagaaggtacagcagctgactacaagagtacccagagcgccatcgaccagattacgggcaaactcaaccgcctgatcgggaagaccaatcaacagttcgagttaatagataacgagtttaatgaaattgagcagcagatcggaaacgtgatcaattggacaagagacgctatgactgaaatttggtcctacaacgccgagctgctcgtggcaatggaaaatcaacacaccatcgatcttgccgactctgagatgagcaaactgtatgagagggtcaagaagcagttgcgggaaaacgctgaggaagatggcacaggttgcttcgagatttttcataaatgtgacgatcagtgcatggaatcaatacgcaataacacttacgaccacacccagtatagaacagagagtctacaaaataggatccagattgatccagttaagctgtccagcgggtacaaagacatcatcctctggttctcttttggcgcgtcatgcttcattctgcttgcaatagccatgggactggtgtttatctgtattaagaacggcaatatgcagtgcaccatctgtatt

SEQ ID NO: 28305 - RNA, 1656 nt, synthetic construct
  misc_feature 1..1656: note = derived and/or modified sequence opt3 from anti-influenza_Chain
  source 1..1656: mol_type = other RNA
atgaacacccagatcctggccttcattgcttgcgtgctcacaggcgtcaagggggacaaaatatgtcttggacaccatgcagttgccaatggtactaaggtgaacacgctgaccgagaaaggcatcgaagtagtgaatgcgacagagactgtcgaaaccgctgatgtgaagaaaatttgcacacaagggaagagagccaccgacttgggaaggtgtggcttactgggtactctaatcgggccccctcagtgcgatcagtttctcgagttcagctccgacctgattatcgaacggcgcgagggaacagatgtttgttacccaggccgatttaccaacgaggaatctcttcgtcagatactgagaaggtcaggcgggatcggaaaggagagtatgggtttcacgtatagcggcattcggactaatggggcaacctccgcctgcacacgctctggatcgtcattttacgctgaaatgaaatggttgctcagcaacagtgacaattccgcattcccgcaaatgactaaggcctatagaaaccccaggaataaacctgctctgatcatttggggcgtgcaccattctgagagcgtctccgagcagaccaagctgtacggttcagggaacaaactcatcacagtgcggagtagcaagtatcagcagtcttttaccccatcccccggagcccgccgaatagatttccactggttactgcttgaccctaatgatacggtaacttttacattcaacggcgcgtttattgcaccagacagagcctcattctttaggggcgagagcttgggggttcaaagtgatgtgcccctggactcttcctgtcggggagattgcttccatagcggtggcaccatcgtctcgtctctacctttccagaatattaactcccgtactgtggggaagtgtccacgctacgtgaaacagaagtcactcctgcttgctacaggaatgagaaatgtcccggaaaaacccaagcctaggggcctgtttggtgccatcgcagggttcatcgaaaacggctgggagggattgattaacggctggtatgggtttcggcaccagaatgctcaaggagaaggtaccgccgcggactacaaaagtacgcagagcgccatagaccagatcaccggcaagctcaaccgactgattgggaaaacaaatcaacagttcgagttaatcgataacgagtttaatgaaatagagcagcagattggaaacgttatcaattggactcgcgacgcaatgaccgaaatctggtcctacaacgctgagctgctcgtggccatggaaaatcaacacacaattgatcttgctgactctgagatgagcaagctgtatgagagagtaaagaaacagttgagggaaaacgccgaggaagatggcactggttgcttcgagatctttcataagtgtgacgatcagtgcatggaatcaattcggaataacacctacgaccacacacagtatcgcaccgagagtctacaaaatagaatacagatcgatccagtgaaactgtccagcgggtacaaggacattatcctctggttctcttttggcgcatcatgcttcctgcttctggccatcgctatgggattggtctttatttgtatcaaaaacggcaatatgcagtgcactatatgtatt

SEQ ID NO: 28306 - RNA, 1656 nt, synthetic construct
  misc_feature 1..1656: note = derived and/or modified sequence opt3 from anti-influenza_Chain
  source 1..1656: mol_type = other RNA
atgaacatccagattctggccttcatagcttgcgtgctcaccggcgcaaagggggacaaaatctgtcttggacaccatgccgtcgcgaatggtacaaaggttaacactctgacggagaaaggcattgaagtggtaaatgctaccgagacagtggaaactgccaacatcaagaaaatttgcacccaagggaagagacccacagatttgggacagtgtggcttactgggtaccctaatcgggcctccacagtgcgaccagtttctcgagttcagctccgatctgataatcgaaaggcgggagggaactgacgtctgttacccgggcaagtttacaaatgaggaatctcttcgccaaattctgcgacgttcaggcgggatcggaaaagagagtatgggtttcacctatagcggcattagaacgaacggggcaacttccgcctgcaccaggtctggatcgtcattttacgctgaaatgaagtggttgctcagcaatagtgataacgcagccttcccccagatgacaaaatcctatcggaatcctcgcaacaagccagctctgatcatatggggcgtgcaccattctgagagcgtttccgagcagactaaactgtacggttcagggaataagctcattaaggtgagaagtagcaaatatcagcaatcttttacccccaaccctggagccaggcggatcgacttccactggttactgcttgatccaaatgacacagtcacctttacgttcaacggcgcgtttattgcacccgatcgcgcctccttctttcgaggcgaatcaatcggggtgcagagcgacgctcctttggatagttcttgtggaggtaattgcttccataacggcgggactatcgtatccagcctgccattccagaacattaatccgagaacagttggaaagtgtcccaggtacgtgaaacagaagtcgctactcctggccaccggcatgcggaacgtccctgagaaaccaaagaaacgtggtctttttggggcaatagctggcttcatcgaaaatggatgggagggcctgattaacgggtggtatggatttcgccaccaaaatgcccagggtgaaggcactgcggccgactacaagtctacacagtccgcaatcgatcaaataaccgggaagttgaacagactcattggaaaaacgaatcagcagttcgagctgatcaacaatgagtttaacgaagtggagcagcaaatcggcaatgtgattaactggacccaggacgctatgacagaagtctggtcatacaatgccgagttactggttgctatggaaaaccagcacactatcgacctcaccgatagtgagatgagcaaactttatgagagggtgcggaagcagctgcgagaaaatgccgaggaagacggtacagggtgcttcgagatttttcataagtgtgatgaccactgcatggaatccatacgcaacaacacttacgatcatacccaatatagaacagagtctttgcagaataggatccagattgaccccgtaaaactaagcggcggatacaaggatatcatcctgtggttctcatttggcgcaagttgcttcctcctgcttgccattgctatggggctggtgtttatatgtatcaagaacggaaatatgcagtgcaccatttgtatc

SEQ ID NO: 28307 - RNA, 1656 nt, synthetic construct
  misc_feature 1..1656: note = derived and/or modified sequence opt3 from anti-influenza_Chain
  source 1..1656: mol_type = other RNA
gaccagatctgcattggctaccacgccaacaatagcaccgagcaagtggatacaataatggaaaagaacgtcactgttacgcatgctcagaatatcctggagaaaacccacaacgggaagctctgtgaccttgatggagtgaaacccctgattttgagagactgctccgtagcaggttggttactgggcaatcctatgtgtgatgagttcctaaacgtgccagaatggtcttatatcgtcgaaaagattaatccggccaacgacctctgctaccccgggaattttaacgattatgaggagctgaaacatcttctgtcaaggatcaatcacttcgaaaagatacagatcattcctaagagtagctggtccgaccatgaggcgtcttcgggagtgtcaagcgcttgtccataccagggccggagttcctttttccgcaacgttgtgtggttgatcaaaaaggataatgcctatcccacaattaaacgatcttacaacaatactaaccaagaagacctcctggtcctgtggggtatccaccaccctaacgatgcagccgagcagacccgtctctatcagaatccaacaacctacataagcgtggggacttccacattaaaccagagactggtacccaagattgctaccaggtcaaaagttaatggacaaagtggccggatggagtttttctggacgatccttaagcctaacgacgcaattaattttgaaagcaacggcaatttcatcgccccagagaacgcttacaagatcgtgaaaaagggggattctactattatgaaatccgaattggagtatggaaattgcaacaccaagtgtcagacaccgataggtgccatcaattcaagcatgccctttcataacattcaccctctgactatcggcgaatgcccaaaatacgtcaagagtaataagctagtgctcgcgaccgggctgcgcaactctccccagggagagagaaggcggaaaaagcgcggccttttcggtgcaatagccgggtttattgagggaggctggcagggcatggtggacgggtggtatggataccatcactccaatgaacaaggtagcggctatgctgccgacaaagagtcgacacagaaggcaatcgatggggtcaccaacaaagttaactctatcattgacaagatgaatacgcagttcgaagctgtgggacgagagtttaacaatctggaaagaaggatcgagaacttgaataaaaagatggaggatggcttcctcgacgtatggacttacaacgccgaactgttagtgctgatggagaatgaacggacactcgatttccacgactccaacgtcaagaatctttatgataaaattcgtctgcaattgcgcgacaacgcgaaggagctaggtaatgggtgttttgagttctaccatagatgcgataacgaatgtatggagtcagtgaggaatggcacctacgactatcctcagtacagtgaagaggcccggctgaaacgagaagagataagcggagttaagctcgagtccatcggcacttatcagattctgtctatctacagcacagtggcatcaagtcttaccctggctatcatggtcgccgggttgtccctctggatgtgcagcaacggatctctgcagtgccgcatttgtata

SEQ ID NO: 28308 - RNA, 1656 nt, synthetic construct
  misc_feature 1..1656: note = derived and/or modified sequence opt3 from anti-influenza_Chain
  source 1..1656: mol_type = other RNA
gaccagatctgcattggctaccacgccaacaatagcaccgagcaagtggatacaataatggaaaagaacgtcactgttacgcatgctcaggacatcctggagaaaacccacaatgggaagctctgtgatcttgacggagtgaaacccctgattttgagagattgctccgtagcaggttggttactgggcaaccctatgtgtgacgaatttatcaatgtgccagagtggtcttatattgtcgaaaaggccaacccgacaaatgatctatgctaccccgggtcatttaacgactatgaggagctcaaacatctgcttagtaggatcaatcacttcgaaaagatacagatcattcctaagagctcctggtctgatcatgaggcgtcgtcaggagtgagcagtgcttgtccatacctgggctccccctctttcttccggaacgttgtgtggttgatcaaaaagaatagcacttatcctaccattaaaaagtcctacaacaatacaaaccaggaagacctcctggtcctgtggggtatccaccacccaaatgatgccgcagagcaaacccgcctctatcagaaccccactacatacatatcaattgggaccagtacgttaaaccagcgactggtgcctaaaatcgccactcgtagcaaggtaaatggacagtctggcagaatggagtttttctggaccattcttaacccaaatgacgctatcaactttgaatccaatggcaacttcatcgcaccggagtacgcctataagattgttaaaaagggggattcagctataatgaaaagcgaattggagtacggaaattgcaacacaaagtgtcaaactcccatgggtgccatcaatagttctatgccttttcataacattcacccactgaccatcggcgaatgccccaaatatgtgaagtccaataggctagtcctcgcgacagggctgcggaacagccctcagcgcgagtcgagaaggaaaaagcggggacttttcggcgcaatagccggttttattgaagggggatggcagggcatggtggacggctggtacgggtatcatcactctaatgaacagggatccggttacgctgccgacaaggagtcaacccaaaaagcaatcgatggcgtgacgaacaaggtcaatagtatcattgacaaaatgaacactcagttcgaagctgttgggcgcgagtttaacaatctggaacgaagaatcgagaacttgaataagaaaatggaggatggattcctcgacgtgtggacatataacgccgaactgttagtactgatggagaatgaaaggaccctcgatttccacgacagcaacgtgaagaatctttacgataaggtccggctgcagttgcgtgacaacgcgaaagagctaggcaatggttgttttgagttctaccataagtgcgataacgagtgtatggagtccattcgcaatgggacttataactacccacaatattctgaagaggccagactgaaaagggaagagataagcggcgtgaagctcgagtcaatcggaacataccagattctgagtatctattccaccgttgcaagctctcttgctctggccatcatgatggctggcttgtcactctggatgtgcagtaatgggagcctgcagtgccggatttgtata

SEQ ID NO: 28309 - RNA, 1656 nt, synthetic construct; identical to SEQ ID NO: 28304
  misc_feature 1..1656: note = derived and/or modified sequence opt3 from anti-influenza_Chain
  source 1..1656: mol_type = other RNA

SEQ ID NO: 28310 - RNA, 1656 nt, synthetic construct; identical to SEQ ID NO: 28305
  misc_feature 1..1656: note = derived and/or modified sequence opt3 from anti-influenza_Chain
  source 1..1656: mol_type = other RNA

SEQ ID NO: 28311 - RNA, 1656 nt, synthetic construct; identical to SEQ ID NO: 28306
  misc_feature 1..1656: note = derived and/or modified sequence opt3 from anti-influenza_Chain
  source 1..1656: mol_type = other RNA

SEQ ID NO: 28312 - RNA, 1656 nt, synthetic construct; identical to SEQ ID NO: 28307
  misc_feature 1..1656: note = derived and/or modified sequence opt3 from anti-influenza_Chain
  source 1..1656: mol_type = other RNA

SEQ ID NO: 28313 - RNA, 1656 nt, synthetic construct; identical to SEQ ID NO: 28308
  misc_feature 1..1656: note = derived and/or modified sequence opt3 from anti-influenza_Chain
  source 1..1656: mol_type = other RNA

SEQ ID NO: 28314 - RNA, 1680 nt, synthetic construct
  misc_feature 1..1680: note = derived and/or modified sequence opt3 from anti-influenza_Chain
  source 1..1680: mol_type = other RNA
atgagcaacatggacatcgattccattaataccggcacaatagacaagactcccgaggaactgacgcctgggacctctggagccacaagaccaatcattaaaccggctactctcgcacccccttcaaacaagaggacccggaatccaagtcccgagcgcacaaccactagctccgaaacagatatcggtcgaaaaattcagaagaaacaaacccctacggagatcaagaagtctgtgtacaaaatggtcgttaaacttggcgaattttataaccagatgatggtgaaagccgggctgaatgacgatatggagcgtaacttgatacagaatgcgcaggctgtagagagaatcttactggccgcaactgacgataagaaaaccgaataccaaaagaagaggaacgcccgggacgtgaaagagggaaaggaagagattgatcacaataaaacaggcggtactttttataagatggtccgcgacgataaaaccatctacttctcgccaattaagatcacatttctaaaagaggaagtgaagaccatgtataagacgactatggggtcagacggattcagcggcctcaaccatataatgattggccacagtcagatgaatgatgtttgctttcagagatccaaagggctgaagagggtgggacttgacccctctctgatcagcacattcgctggttccaccttgcctcggcgctcaggcactacaggggtcgcaattaaaggaggcggtaccctcgtggacgaggccatccgatttatcgggagagctatggccgataggggactgctgcgggacattaaggcgaaaacggcatacgaaaagatactcttaaacctgaagaataaatgtagtgccccacagcaaaaggctcttgtagatcaggttatcggcagccgtaacccgggcattgccgacatcgaggatttgaccctgctagcacgctctatggtggtcgtgagaccctccgtggcttcaaaagtcgttctccctataagcatttatgccaagatcccacagctggggttcaatacagaagagtacagtatggtgggatacgaggcgatggccctttataacatggcaactcccgtatctatcctgaggatgggtgacgatgctaaagacaagtcccagttgtttttcatgagctgctttggcgccgcttacgaagatctccgggtgctgtcggccttaaccgggacagagttcaagcctcgatctgcactgaaatgtaagggatttcatgtcccagccaaagaacaagtggagggcatgggtgctgcgctcatgtccattaaacttcagttctgggcacccatgactcgctcagggggcaacgaagttagtggagagggcgggagcggacagatctcctgctctccggtgttcgccgtcgagagacctattgctctgagcaagcaagccgtgaggcggatgttgtcaatgaatgtagaaggtcgcgacgcagatgttaagggcaacctactgaagatgatgaatgacagtatggccaaaaagacctccgggaacgcttttataggaaagaagatgttccagatcagcgacaaaaataaggtgaaccccattgagatcccaatcaaacagacaattcctaatttcttctttggcagagataccgccgaagactatgatgacctcgattac

SEQ ID NO: 28315 - RNA, 1680 nt, synthetic construct
  misc_feature 1..1680: note = derived and/or modified sequence opt3 from anti-influenza_Chain
  source 1..1680: mol_type = other RNA
atgaacacccagatcctggccctcattgcttacatgcttataggcgcaaagggggacaaaatctgcctgggacaccatgccgtggcgaatggtacaaaggtcaacactttgacggagagaggcattgaagttgtgaatgctaccgagacagtagaaactgtgaacatcaaaaagatttgtacccaagggaaaaggcccacagatttaggacagtgcggcctgctaggtaccctcatcgggcctccacagtgtgaccagttcctggagtttgatgccgaccttataatcgaacggcgcgagggaactgatgtctgctatccgggcaagttcacaaatgaggaaagcctgcgacaaattttgcgtggctccgggggaatcgacaaggagtctatgggttttacctactcaggcattagaacgaacggggtgaccagtgcatgtaggcggagcggatcctctttctatgccgaaatgaaatggctcctgtctaattcagataacgctgcatttccccagatgactaagagctaccgcaatcctagaaacaaaccagccctgatcatatggggcgttcaccatagtggttccgctacagagcagactaagctctatgggtctggaaataaattaattaccgtgggcagctccaagtaccagcaatcattcacacccagtcctggcgccaggccacaggtcaacgggcagagcggacggatcgactttcactggctgcttttggatcccaatgacaccgtgacgttcacttttaacggtgcgttcattgcacctgatcgcgcctcgtttttccgaggcgagtccctgggggtacagtcagacgttccactagatagcggatgcgaaggcgactgttttcatagtagaggtacaatcgtgtcttccctcccgttccaaaatatcaaccccaggaccgtcgggaagtgccctcggtatgtgaaacagactagcctgcttctggctacaggcatgcgtaacgtgccagagaatcccaagacccgcggattgttcggcgccattgcagggtttatagaaaacggatgggagggtctcatcgacggctggtacgggttcagacaccagaatgctcaaggagaaggcacggccgcggattacaaatcgacccagtctgccattgaccagatcacaggtaagctgaacaggttaatagataaaactaatcagcaatttgagctgattgacaacgagttctccgaaatcgagcagcagatcgggaatgtcattaactggacccgggattcaatgacagaagtttggagttataatgcagagctccttgtggctatggaaaaccagcacactatcgacctggccgatagcgagatgaataagttgtacgagcgagtacgcaaacaactaagagaaaacgctgaggaagacggcaccggatgttttgagattttccataagtgcgatgaccagtgtatggaatccataaggaataacacatatgatcacacccagtaccggactgagtctctgcagaatcgcatccaaattgaccctgtgaagctcagctcaggctataaagacatcatcctgtggtttagtttcggggcctcctgctttcttctgttggcaattgccatgggactcgtcttcatatgcatcaagaacggtaacatgagatgtacgatttgcatc

SEQ ID NO: 28316 - RNA, 1680 nt, synthetic construct
  misc_feature 1..1680: note = derived and/or modified sequence opt3 from anti-influenza_Chain
  source 1..1680: mol_type = other RNA
atgaacacccagatcctggccctcattgcttgcatgcttataggcgcaaagggggacaaaatctgtctgggacaccatgccgtggcgaatggtacaaaggtcaacactttgacggagagaggcattgaagttgtgaatgctaccgagacagtagaaactgccaacatcaaaaagatttgcacccaagggaaaaggcccacagatttaggacagtgtggcctgctaggtaccctcatcgggcctccacagtgcgaccagttcctggagtttgatgcagaccttataatcgaacggcgcgagggaactgatgtgtgttacccgggcaagttcacaaatgaggaaagcctgcgacaaattttgcgtggctccgggggaatcgacaaggagtctatgggttttacctattcaggcattagaacgaacggggccaccagtgcttgcaggcggagcggatcctctttctacgcagaaatgaaatggctcctgtctaattcagataacgccgcttttccccagatgactaagagctatcgcaatcctagaaacaaaccagccctgatcatatggggcgtccaccatagtggttccgcgacagagcagactaagctctacgggtctggaaataaattaattaccgtgggcagctccaagtatcagcaatcattcacacccagtcctggcgcaaggccacaggttaacgggcagagcggacggatcgactttcactggctgcttttggatcccaatgacaccgtgacgttcacttttaacggtgccttcattgctcctgatcgcgcctcgtttttccgaggcgggtccctgggagtccagtcagacgtgccactagatagcggctgtgagggtgactgctttcatagtgggggcacaatcgtatcttccctcccgttccaaaatatcaaccccagaaccgttggaaagtgtcctaggtacgtgaaacagactagcctgcttctggcaacaggcatgcggaacgtcccagaaaatcccaagacccgtgggttgttcggagctattgccggttttatagagaacggctgggaagggctcatcgacggatggtatggcttccgccaccagaatgcgcaaggtgaggggacggccgcagattacaaatcgacccagtctgctattgaccagatcacaggcaagctgaacagattaatagataaaactaatcagcaatttgaactgattgacaacgagttcaatgagatcgaacagcagatcggaaacgtgattaattggaccagggattccatgacagaggtgtggtcatacaacgccgaactccttgtcgctatggagaatcagcacactatcgacctggccgatagtgaaatgaacaagttgtatgagcgggttcgaaaacaactacgcgagaatgcagaagaggacggcaccgggtgctttgaaattttccataagtgtgatgaccagtgcatggagagcataagaaacaatacatacgatcacacccagtataggactgaatccctgcagaaccggatccaaattaaccctgtgaagctctctagcggatacaaagacatcatcctgtggttttcattcggtgccagttgctttcttctgttggctattgcgatgggcctcgtattcatatgtatcaagaatgggaacatgcgctgcacgatttgtatc

SEQ ID NO: 28317 - RNA, 1680 nt, synthetic construct
  misc_feature 1..1680: note = derived and/or modified sequence opt3 from anti-influenza_Chain
  source 1..1680: mol_type = other RNA
atggagagaatcgtgctgctccttgccattgtcagcctggttaagtccgaccagatatgcatcggctaccacgctaacaattctaccgaacaagtggatacaattatggagaaaaacgtaactgtgacgcatgcacaggacatcttggaaaagacccacaatgggaaattatgtgatctggacggagtcaagcccctaattctcagggattgctcagtggccggttggctgcttggcaaccctatgtgtgacgagttcctgaatgttccagaatggagttatatcgtggagaaaataaacccggcgaatgatttgtgctaccccgggaactttaatgactatgaggaactcaagcatctgctgagccggatcaaccacttcgagcgcattcagatcattcctaagtcctcttggtcggatcatgaagctagtagcggagtcagttccgcctgtccataccagggccgatctagctttttccgtaatgtggtatggctcatcaaaaagaacaatgcatatcccacaataaaaagatcctacaacaatactaaccaagaggacttactggttctttggggtattcaccaccctaacgatgccgctgagcagaccaggttgtatcagaatccaacaacctacatctcagtggggacttcaacactgaaccagcggctagtccccaagattgcaacccgcagcaaagtgaatggacaatctggcagaatggaatttttctggacgatcctcaagcctaacgacgccatcaattttgagtccaacggcaatttcattgctccagaaaacgcctacaagaattgccagaaaggggattcaactataatgaaaagcgagctggaatatggaaactgtaataccaagtgccagacaccgatcggtgcgattaacagttctatgccctttcataatatccaccctcttactataggcgagtgtccaaagtacgtgaaatccaacaggctggtcttggcaaccgggctccggaatagcccccagggagagcgccgaagaaagaaaaggggcctgttcggtgccattgctgggtttatcgaaggaggctggcaaggcatggttgacgggtggtatggataccatcactcgaacgagcagggttctggctatgccgcagacaaggaatccacacagaaggctatcgatggggtgaccaacaaagtaaattcaattatcgacaagatgaacacgcaattcgaggccgtgggacgggaatttaataacttagagcgtcgcattgagaatctgaacaaaaagatggaagatggcttcctcgacgtctggacttacaatgcggagcttctggtgttgatggaaaacgagagaacactagatttccacgacagtaatgttaaaaacctgtatgataaggtgaggctccagctgcgggacaatgccaaggaacttggtaacgggtgctttgagttctaccatcgatgtgataatgagtgcatggaaagcgtccgcaacggcacctacgactatcctcagtactccgaggaagcaagactgaaaagggaggagatatctggagtgaagttggaaagcatcggcacttatcagattctctcaatctacagtacagtagcttccagcctggccttagctatcatggttgccgggctgtctctatggatgtgctcaaatgga

SEQ ID NO: 28318 - RNA, 1680 nt, synthetic construct; identical to SEQ ID NO: 28314
  misc_feature 1..1680: note = derived and/or modified sequence opt3 from anti-influenza_Chain
  source 1..1680: mol_type = other RNA

SEQ ID NO: 28319 - RNA, 1680 nt, synthetic construct; identical to SEQ ID NO: 28315
  misc_feature 1..1680: note = derived and/or modified sequence opt3 from anti-influenza_Chain
  source 1..1680: mol_type = other RNA

SEQ ID NO: 28320 - RNA, 1680 nt, synthetic construct; identical to SEQ ID NO: 28316
  misc_feature 1..1680: note = derived and/or modified sequence opt3 from anti-influenza_Chain
  source 1..1680: mol_type = other RNA

SEQ ID NO: 28321 - RNA, 1680 nt, synthetic construct; identical to SEQ ID NO: 28317
  misc_feature 1..1680: note = derived and/or modified sequence opt3 from anti-influenza_Chain
  source 1..1680: mol_type = other RNA

SEQ ID NO: 28322 - RNA, 1686 nt, synthetic construct
  misc_feature 1..1686: note = derived and/or modified sequence opt3 from anti-influenza_Chain
  source 1..1686: mol_type = other RNA
atgcccagagccctgaggcgggtgcctggcagccgcgtcatgctccgagttggggtggtagtggctgtccttgcactggtggccgcgttggctaacttagccgttccacgtccggcaagagccgctggaggtggctactggcacacctccgggagggagatcctggacgcaaataacgtgcccgtccggattgccggaataaattggttcggctttgaaacatgcaactatgtggtacatggtctatggtctcgcgattacagatcaatgctcgaccagatcaagagtctggggtataatactattaggcttccttacagcgatgacatcctgaaaccaggaacgatgcccaactccattaatttctatcaaatgaaccaggatttgcagggcctcacctctctgcaggttatggacaagatcgtggcttacgccggccaaatagggctgcggatcattctcgatcgccaccgacctgactgttcgggacagtcagcgttatggtatacaagcagtgtctccgaggcaacttggatctctgatctgcaggcccttgctcagagatacaaaggtaatccaaccgtggtgggctttgacttgcataacgaaccccacgatcctgcctgctgggggtgtggagacccaagcattgattggaggctggcagctgagcgggccggcaatgcggtcctatccgttaacccgaatctcctgatcttcgtggaaggtgtacaatcatacaacggggacagttattggtggggaggcaatcttcagggcgccgggcagtaccccgtggtcctgaacgtgcctaaccgtttggtttatagcgcacatgactacgctacatctgtgtatccacagacctggttttccgatcccactttccctaataacatgccaggaatatggaataagaactggggttacctctttaatcaaaacattgcccccgtctggctgggcgagttcgggacaaccttacagtcaacgactgaccagacctggctgaaaacactcgtgcaatatcttcgcccgactgctcagtacggagccgatagctttcagtggaccttctggagttggaatcctgactctggcgatacaggtgggatcctgaaggacgattggcagaccgtagacacggttaaggatggctacttggcacccattaaatccagcatctttgacccagtgggagcctcggcttctccttcctcacaacccagtccaagcgtctccccctctcctagcccatcaccgagtgcgtccagaactcccacacctaccccaactcccacagcaagccctaccccaacgctaacccccacagccactccgacccctacagcttctccaactccctcacctaccgccgcaagtggcgccaggtgcacagctagctatcaggtgaactccgattgggggaatggattcaccgtcactgtggccgttacgaactctggttcggtggcaacaaagacctggactgtaagctggacctttggcgggaatcagacaatcaccaactcctggaatgcggctgtcactcagaacggacaatcagtgacagcccggaatatgagttacaacaacgttattcagcccggccagaatacgaccttcggtttccaggcatcttatactgggagcaacgccgctccaacagtggcctgtgcagcttcc

SEQ ID NO: 28323 - RNA, 1686 nt, synthetic construct
  misc_feature 1..1686: note = derived and/or modified sequence opt3 from anti-influenza_Chain
  source 1..1686: mol_type = other RNA
atggagagagtgtggtggaaggaagccgtcgtttaccagatctatcccaggagcttctacgactccaacggcgatgggattggagacatacggggtatcattgctaaactggattatctcaaggagcttggcgtggacgtagtgtggctgtctcctgtctacaaatcaccaaatgatgacaacgggtatgatatcagtgactaccgcgatattatggacgaatttggaaccatggcagattggaagacaatgttggaggaaatgcacaaacgaggcatcaagttagtgatggacctggttgtgaatcatactagcgatgagcacccgtggttcatagagtcccgtaagtctaaagacaacccctatagagactactacatctggaggcctggtaagaatgggaaagaaccaaacaattgggagtcggtcttttcaggaagcgcctgggaatatgatgagatgacgggcgagtactatctacatctcttcagtaagaaacaacccgacctgaactgggaaaatcctaaggtgcggcgcgaggtatacgaaatgatgaagttttggcttgataaaggcgttgacgggttcagaatggatgtgattaacatgatctccaaggtcccagagctgcccgacggagaacctcagtctggtaaaaagtatgcgagcggctccaggtactatatgaatgggccacgggtgcacgagtttttgcaggagatgaaccgcgaagtgctctcaaaatacgatattatgaccgtcggagagacaccgggcgttactcccaaggaaggtatcctgtacaccgaccctagtcgaagagagctgaatatggtgttccagtttgaacatatggatctcgacagcgggccaggaggcaaatgggatataaggccctggtctttagctgacctgaagaagacaatgaccaaatggcaaaaggagcttgagggcaaagggtggaactccttgtatctgaataaccacgaccagcctcgggccgtatcacgtttcggagatgacggtaagtaccgcgtggaaagcgcaaaaatgctagccacttttctccacatgatgcagggcacaccatatatttaccagggggaggaaatcggaatgaccaacgtcagattccccagtattgaggattatagggacatcgaaacgctgaatatgtacaaggagcgggtggaggaatatggcgaggatccgcaagaagttatggagaagatctactacaaaggtcgagacaacgctcgcactcctatgcagtgggatgactctgagaatgcagggtttaccgccggcacaccctggattccagtgaaccctaattataaggaaataaacgtcaaagctgcccttgaggatcccaattccgtgttccattactataagaaactgatccagttgagaaagcagcacgacattatcgtatacggaacttatgatctcatactggaagacgatccatacatttataggtacacccggacattaggcaacgagcaactgatcgttatcaccaatttcagcgaaaagacgcccgtgtttcgcctccctgaccatattatctacaaaactaaggagcttctgatttcgaactatgacgtcgatgaggcggaagagttgaaagaaataagactaaggccatgggaggcacgtgtgtacaagatccggctgccg

SEQ ID NO: 28324 - RNA, 1686 nt, synthetic construct; identical to SEQ ID NO: 28322
  misc_feature 1..1686: note = derived and/or modified sequence opt3 from anti-influenza_Chain
  source 1..1686: mol_type = other RNA

SEQ ID NO: 28325 - RNA, 1686 nt, synthetic construct; identical to SEQ ID NO: 28323
  misc_feature 1..1686: note = derived and/or modified sequence opt3 from anti-influenza_Chain
  source 1..1686: mol_type = other RNA

SEQ ID NO: 28326 - RNA, 1689 nt, synthetic construct
  misc_feature 1..1689: note = derived and/or modified sequence opt3 from anti-influenza_Chain
  source 1..1689: mol_type = other RNA
atggagaagatcgtgctcctgttcgccattgtcagccttgttaaatccgaccagatatgcatcggctaccacgctaacaattctaccgaacaagtggatacaattatggagaagaacgtaactgtgacgcatgcacaggacatcctggagaaaaagcacaatgggaaattgtgtgatttagacggagtcaagcccctgattctaagagattgctcagtggccggttggctcctgggcaaccctatgtgtgacgaatttatcaatgttccagaatggagttatatagtggagaaggcgaacccggtcaatgatctttgctaccccggggacttcaacgattatgaggaactgaaacatttgctcagcaggatcaatcactttgagaagattcagatcattcctaaatcctcttggtcgtcacatgaagctagcctgggagtgagttccgcctgtccataccagggcaagacctctttctttcggaacgtagtttggctgatcaaaaagaatagcacatatcccactataaagcgctcctacaacaataccaaccaagaggacctcttagtgctgtggggtattcaccaccctaatgatgcagccgagcagacaaaactttatcagaacccaaccacttacatctcagtcgggacaagtaccttgaaccagcgactggtgccccgtattgctacgagaagcaaggtgaatggacaatctggcaggatggagttcttttggactatcctaaaacctaacgacgcaatcaatttcgaatccaacggcaattttattgccccagaatacgcttataagatagtcaaaaagggggattcaaccatcatgaaaagcgagctcgaatacggaaactgcaatacaaagtgtcagactccgatgggtgccattaacagttctatgcccttccataatatccaccctctgaccataggcgagtgcccaaagtatgttaaatccaaccggcttgtgctggcgacagggttgcgcaatagcccccagagagagaccaggggactctttggcgcaattgccggtttcatcgaagggggatggcagggcatggtagacggctggtacgggtatcatcactcgaacgagcaaggatctggttacgctgccgacaaggaatccacgcagaaagcaatcgatggcgtgactaataaggtcaactcaattatcgacaaaatgaatacacagtttgaggctgtggggcgggagttcaacaacctggaacgccgaattgagaatttaaacaagaagatggaagatggattcctggacgtttggacctataatgccgagctccttgtgctgatggaaaacgagagaactttggattttcacgacagtaatgtcaaaaacctatacgataaggtgaggctgcaactccgggacaatgcgaaagaactgggcaacggttgtttcgagttttaccataagtgcgataatgagtgtatggaaagcgtacgtaacgggacatatgactaccctcagtattccgaggaagcccgccttaaaagagaggagatatctggcgttaagctggaaagcatcggaatttaccagatcttgtcaatctatagtaccgtggcatccagcctcgctctggccattatggtcgctggcttatctctgtggatgtgctcaaatgggagtctacagtgcaggatatgt

SEQ ID NO: 28327 - RNA, 1689 nt, synthetic construct; identical to SEQ ID NO: 28326
  misc_feature 1..1689: note = derived and/or modified sequence opt3 from anti-influenza_Chain
  source 1..1689: mol_type = other RNA

SEQ ID NO: 28328 - RNA, 1692 nt, synthetic construct
  misc_feature 1..1692: note = derived and/or modified sequence opt3 from anti-influenza_Chain
  source 1..1692: mol_type = other RNA
atggagaagatcgtgctcctgttcgccattgtcagccttgttaaatccgaccagatatgcatcggctaccacgctaacaattctaccgaacaagtggatacaattatggagaagaacgtaactgtgacgcatgcacaggacatcctggaaaagacccacaatgggaagttgtgttcattaaacggagtcaaacccctgattctaagagattgcagtgtggccggttggctcctgggcaatcctatgtgtgacgagtttcttaacgttccagaatggagctatatcgtggagaaggattccccgataaatgggctgtgctaccccggagacttcaacgattatgaggaattgaagcatctcctgtcttcgacaaatcactttgagaaaatccagattatccctaggtcaagctggagtgaccatgatgcgtcctctggcgtcagctccgcttgtccatacaacggtcggtcaagtttctttcgcaatgtggtatggctgattaagaaaaacaatgcctatcccactatcaagcgaaactacaataacaccaaccaggaagacctcttagttctgtgggggatacaccaccctaatgatgcaacagagcaaaccaaactttatcagaacccaactacatacgtgagcgtcggaacctctacgttgaatcagcgttccgtgcccgagattgccactagacctaaggtgaacggccagtcaggcaggatcgagttcttttggaccattctgaagccaaatgacgctatcaacttcgaaagcaatgggaactttatcgcaccggaatacgcctataaaattgctaagaaaggagatagtgccataatgaagtctggtctagagtacggcaattgcaacacaaaatgtcaaactcccatgggggcgatcaattccagcatgcctttccataacattcacccactcaccatcggagaatgcccccggtatgtcaagtcggaccgcctggttcttgcaacaggcctgagaaatgtgcctcagagggagacccggggtttgtttggggccatagctggattcattgagggcggctggcaggggatggtagacggatggtacggttatcatcactctaacgaacagggctccgggtacgccgcagataaagagtcaacgcaaaaggctatcgacggaatcactaataaggtgaacagtattatcgataaaatgaacacacagtttgaagccgtcggcaaggagttcaataacctcgaacgccgaattgagaatctgaacaaaaagatggaggacggtttcttagatgtgtggacctataatgcggaactgctcgttcttatggagaacgaaagaactctggactttcacgatagcaatgtgaaaaacttgtacgacaaggtcaggctacagctgcgggataatgccaaggagctcgggaacggctgtttcgaattttaccataaatgcgacgatgagtgtatggagtccgtgcgtaatggaacatatgactacccacaatattctgaagaggcacgcctgaacagagaagagataagcggcgtaaaacttgagtcaatcgggacctaccagattctgagtatctattccacggttgctagctctttggccctcgctatcatggtggccggactgtcattctggatgtgcagtaatggtagcttacagtgcaggatttgtata

SEQ ID NO: 28329 - RNA, 1692 nt, synthetic construct; identical to SEQ ID NO: 28328
  misc_feature 1..1692: note = derived and/or modified sequence opt3 from anti-influenza_Chain
  source 1..1692: mol_type = other RNA

SEQ ID NO: 28330 - RNA, 1695 nt, synthetic construct
  misc_feature 1..1695: note = derived and/or modified sequence opt3 from anti-influenza_Chain
  source 1..1695: mol_type = other RNA
atggagaagatcgtgctcctgttcgccattgtcagccttgttaaatccgaccagatatgcatcggctaccacgctaacaattctaccgaacaagtggatacaattatggagaagaacgtaactgtgacgcatgcacaggacatcctggagaaaaagcacaatgggaaattgtgtgatttagacggagtcaagcccctgattctaagagattgctcagtggccggttggctcctgggcaaccctatgtgtgacgaatttatcaatgttccagaatggagttatatagtggagaaggcgaacccggtcaatgatctttgctaccccggggacttcaacgattatgaggaactgaaacatttgctcagcaggatcaatcactttgagaagattcagatcattcctaaatcctcttggtcgtcacatgaagctagcctgggagtgagttccgcctgtccataccagggcaagtctagcttctttcggaacgtagtttggctgatcaaaaagaactccacctatcccacaataaagcgctcatacaataatactaaccaagaggacctcttagtgctgtggggtattcaccaccctaatgatgcagccgagcagaccaaactttatcagaacccaacaacctacatcagtgtcgggactagcacattgaaccagcgactggtgccccgtattgctaccagatctaaggtgaatggacaatccggcaggatggagttcttttggacgatcctaaaacctaacgacgcaatcaatttcgaatcaaacggcaattttattgccccagaatacgcttataagatagtcaaaaagggggatagcactatcatgaaaagtgagctcgaatacggaaactgcaataccaagtgtcagacaccgatgggtgccattaactcttccatgcccttccataatatccaccctctgactataggcgagtgcccaaagtatgttaaaagcaaccggcttgtgctggcgaccgggttgcgcaattcgccccagagagagaggcggcgcaagaaacgaggactctttggcgcaattgccggtttcatcgaagggggatggcagggcatggtagacggctggtacgggtatcatcactctaacgagcaaggatccggttacgctgccgacaaggaatcaacacagaaagcaatcgatggcgtgaccaataaggtcaacagtattatcgacaagatgaatacgcagtttgaggctgtggggagagagttcaacaacctggaaaggcggattgagaatttaaacaaaaagatggaagatggattcctggacgtttggacttataatgccgagctccttgtgctgatggaaaacgagcgtacattggattttcacgacagcaatgtcaaaaacctatacgataaggtgcgcctgcaactcagagacaatgcgaaagaactgggcaacggttgtttcgagttttaccataagtgcgataatgagtgtatggaatccgtaaggaacgggacctatgactaccctcagtattctgaggaagcccggcttaagcgagaggagataagcggcgttaaactggaatcaatcggaatttaccagatcttgagtatctattccactgtggcaagctctctcgctctggccattatggtcgctggcttatcactgtggatgtgcagtaatgggagcctacagtgccgc

SEQ ID NO: 28331 - RNA, 1695 nt, synthetic construct
  misc_feature 1..1695: note = derived and/or modified sequence opt3 from anti-influenza_Chain
  source 1..1695: mol_type = other RNA
atggagaagatcgtgctcctgttcgccattgtcagccttgttaaatccgaccagatatgcatcggctaccacgctaacaattctaccgaacaagtggatacaattatggagaagaacgtaactgtgacgcatgcacaggacatcctggaaaagacccacaatgggaagttgtgtgatttagacggagtcaaacccctgattctaagagattgctcagtggccggttggctcctgggcaaccctatgtgtgacgagtttatcaatgttccagaatggagttatatagtggagaaggcgaacccggtcaatgatctttgctaccccggggacttcaacgattatgaggaactgaagcatttgctcagcaggatcaatcactttgagaaaattcagatcattcctaagtcctcttggtcgtcacatgaagctagcctgggagtgagttccgcctgtccataccagggcaaatctagcttctttcggaacgtagtttggctgatcaagaaaaattccacatatcccactataaagcgctcatacaacaataccaaccaagaggacctcttagtgctgtggggtattcaccaccctaatgatgcagccgagcagacaaaactttatcagaacccaaccacttacatcagtgtcgggacaagcaccttgaaccagcgactggtgccccgtattgctacgagatctaaagtgaatggacaatccggcaggatggagttcttttggactatcctaaagcctaacgacgcaatcaatttcgaatcaaacggcaattttattgccccagaatacgcttataaaatagtcaagaaaggggatagcaccatcatgaagagtgagctcgaatacggaaactgcaatacaaaatgtcagactccgatgggtgccattaactcttccatgcccttccataatatccaccctctgaccataggcgagtgcccaaagtatgttaagagcaaccggcttgtgctggcgacagggttgcgcaattcgccccagagagagaggcggcgcaaaaagcgaggactctttggcgcaattgccggtttcatcgaagggggatggcagggcatggtagacggctggtacgggtatcatcactctaacgagcaaggatccggttacgctgccgacaaagaatcaacccagaaggcaatcgatggcgtgacgaataaagtcaacagtattatcgacaagatgaatactcagtttgaggctgtggggagagagttcaacaacctggaaaggcggattgagaatttaaacaagaaaatggaagatggattcctggacgtttggacatataatgccgagctccttgtgctgatggaaaacgagcgtaccttggattttcacgacagcaatgtcaagaacctatacgataaagtgcgcctgcaactcagagacaatgcgaaggaactgggcaacggttgtttcgagttttaccataaatgcgataatgagtgtatggaatccgtaaggaacgggacttatgactaccctcagtattctgaggaagcccggcttaagcgagaggagataagcggcgttaagctggaatcaatcggaatttaccagatcttgagtatctattccacagtggcaagctctctcgctctggccattatggtcgctggcttatcactgtggatgtgcagtaatgggagcctacagtgccgc

SEQ ID NO: 28332 - RNA, 1695 nt, synthetic construct
  misc_feature 1..1695: note = derived and/or modified sequence opt3 from anti-influenza_Chain
  source 1..1695: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaaattatgtgatctggacggagtcaaacccctaattctcagagattgctcagtggccggttggctgcttggcaaccctatgtgtgacgagttcatcaatgttccagaatggagttatatagtggagaaggcgaacccggctaatgatctgtgctaccccgggaactttaatgactatgaggaattgaagcatctcctgagcaggatcaaccacttcgagaaaattcagatcattcctaagtcctcttggtcggatcatgaagcctcaagcggagtcagttccgcatgtccataccagggcaaatctagctttttccggaatgtggtatggctgatcaagaaaaactcctcatatcccacaataaagcgcagttacaataacactaatcaagaggacctcttagttctgtggggtattcaccaccctaacgatgccgctgagcagacccgactttatcagaacccaacaacctacatcagcgtggggacttctacattgaatcagcgtctggtccccaagattgcaaccagatccaaagtgaacggacaatcaggcaggatggaatttttctggacgatcctaaagcctaatgacgccatcaactttgagagcaatggcaacttcattgctccagaatacgcctataaaatagtgaagaaaggggatagtgcgatcatgaagtctgagctcgaatacggaaattgcaacactaaatgtcagaccccgatgggtgcaattaattccagcatgccctttcataacatccaccctctgacaataggcgagtgcccaaagtatgtcaagtcgaatcggcttgttctggccactgggttgcgcaactctccccagagagagaggcggcgcaaaaagcgaggactcttcggcgctattgccggttttatcgaagggggatggcagggcatggtggacggctggtacgggtatcatcactccaatgagcaaggatcaggttacgcagctgacaaagaaagtacccagaaggccatcgatggcgtaacaaacaaagtgaatagcattatcgacaagatgaacacccagttcgaggcggtcgggagagaatttaacaatctggagaggcggattgagaacttaaataagaaaatggaagatggattcctggacgtgtggacgtataacgccgagctccttgttctgatggaaaatgagcgtactttggatttccacgactccaacgtgaagaatctatacgataaagtccgcctgcaactcagagacaacgcaaaggaactgggcaatggttgttttgagttctaccataaatgcgataacgagtgtatggaatctgtgaggaatgggacatatgactaccctcagtatagcgaggaagctcggcttaagcgagaggagatatcaggcgtaaagctggaaagtatcggaatttaccagatcttgtccatctatagcaccgttgcctcttcactcgctctggccattatggtggcaggcttaagtctgtggatgtgcagcaacgggtccctacagtgccgc

SEQ ID NO: 28333 - RNA, 1695 nt, synthetic construct
  misc_feature 1..1695: note = derived and/or modified sequence opt3 from anti-influenza_Chain
  source 1..1695: mol_type = other RNA
atgagcgacagaaggcagaaccggaagacccccgatgagcaacgcaaagcaaatgctctgatcattaacgaaaatatagaggcatacatcgccatttgcaaggaagtgggcctcaacggggacgagatgcttatcctggaaaatggaattgcgatcgagaaagctatacgaatctgttgcgatggtaagtatcaggagaaacgtgaaaagaaggccagagaggcacagagggccgactccaacttcaatgctgattctattggcatccggttggtcaaacgcgcagggtcaggaacaaacattacttaccacgccgttgtggaattaacgagtagaagcaggatcgtacagatactgaagtcccattggggcaatgagctaaaccgggctaaaattgccggtaagcgcctcgggttttctgcgctgttcgcatcgaatcttgaggccatcatttatcaacgaggaagaaacgctgccaggcggaatggctcagcagaactgtttaccttgacacagggcgctgggatcgagactcgttacaaatggatcatggaaaagcacattggaataggtgtgctcatcgccgacgcgaagggcctgattaacgggaaacgcgagggaaagagaggcgtcgatgccaatgtgaaactgagggcaggtaccacagggagccctctcgaacgggctatgcagggaatcgagaagaaagccttcccaggcccgttacgagctctggcccgcagagttgtgaaggcaaactataacgacgccagggaggctcttaatgtcatagcggaagcaagtttgctgctaaaaccccagattaccaacaagatgactatgccttggtgtatgtggctcgccgctcggctgacacttaaggatgagtttgccaatttctgcgcatacgccggccgcagagcttttgaagtgttcaacatcgccatggagaaaatcgggatttgttcctttcaaggaaccatcatgaatgacgatgaaattgagtctatagaggacaaggcacaggtactgatgatggcgtgcttcggtttggcttatgaagattttagcctcgtttccgccatggtgtcacatccactgaaattaaggaaccgtatgaagatcggcaatttccgggtcggggagaaagtgagtacggtgctgagccccctccttcgatttactagatgggcagagttcgcccagaggttcgctctgcaggccaacacctctcgcgagggagcacaaatttccaattcagctgtctttgccgttgaacggaagatcacaactgacgtgcagagagtagaggagttgctaaacaaggtgcaggcgcacgaagacgagcctctgcaaaccctctacaaaaaggtcagggaacagatcagcattataggccgcaataaaagtgagatcaaggagttcctgggttcttccatgtacgatcttaacgaccaggaaaaacagaatccaattaactttcgaagcggggcccatcccttctttttcgagtttgatcctgactataatccaatccgggtgaagcgtccgaagaaacccattgctaagagaaactcgaacatctctaggctggaagaggaaggcatggatgaaaattccgagataggacaagccaaaaagatgaaacctttggaccagctcacatcaaccagtagcaacatcccaggcaagaat

SEQ ID NO: 28334 - RNA, 1695 nt, synthetic construct
  misc_feature 1..1695: note = derived and/or modified sequence opt3 from anti-influenza_Chain
  source 1..1695: mol_type = other RNA
atgaaggtgaaactgctcgtccttctgtgcaccttcacagccacttacgctgacacgatctgtattggctatcacgcaaacaatagcaccgatacagttgacactgtgttggagaagaacgtaaccgtgacacattccgtcaatttactggaaaactctcacaatgggaaactatgcctcctgaagggaatagcgccccttcagctgggtaactgttcagtggccggctggatcttggggaatcctgagtgcgaactcctgattagtaaagagagctggtcctacatcgttgaaaagccaaacccggagaatggaacctgttatcccggccattttgctgattacgaggaactgagagagcaactctcttcggtgagctcattcgaaaggtttgagattttccctaaggagagttcctggccaaaccacactgtcacaggtgtgtctgccagctgctcccataatggggaatcaagtttttatcggaacttactgtggcttaccggcaaaaatggattgtaccccaacctgagcaagtcttatgcaaataacaaagagaaggaagttctagtactctggggcgtgcaccaccctccaaacatcggggaccagaaagccctgtaccatacggagaatgcttacgtctccgtggtgtcaagccactatagtcgcaagttcactcccgaaatagcaaagcgacctaaagtccgtgatcaggagggaagaatcaactaccattggacccttctggagccaggtgacacaattatctttgaagccaatggcaacttgattgctccgaggtatgccttcactctctctcgggggtttggatccggcatcataaatagcaacgcgcccatggataagtgtgacgcaaaatgccagacccctcaaggtgccattaattcgtctctgccattccagaacgttcaccccgtgacaatcggggagtgtcctaagtacgtacgctccgctaaattaagaatggtgaccggactgaggaatattccatcaatccagagtcggggcctctttggcgccatcgcagggttcattgaaggaggttggacgggcatggtcgatgggtggtatggataccaccatcagaacgagcaaggcagcggttatgctgccgaccagaagtccactcagaatgcgataaacgggatcacaaataaagtgaactctgttattgaaaagatgaatacccagtttactgccgtgggcaaggagttcaacaaacttgagcgccgaatggaaaacctgaataagaaagtcgatgacggattcatcgatatatggacatacaacgcagagttgctagtgctgctcgaaaatgagagaaccctggactttcacgacagcaacgtaaagaatctttacgaaaaagttaagtcacaactgaagaacaatgctaaagagattggcaacgggtgcttcgagttttatcataagtgtaatgatgaatgcatggagagtgtgaaaaacggaacgtacgactatcccaagtactccgaagagagcaaattgaatagggagaagatcgatggtgtcaagctcgaatctatgggcgtgtatcagatcctggccatttactcaaccgtcgctagtagcttagtgctgctagtttccctcggggccatctctttctggatgtgctcgaacggaagcctgcagtgtcggatttgcata

SEQ ID NO: 28335 - RNA, 1695 nt, synthetic construct
  misc_feature 1..1695: note = derived and/or modified sequence opt3 from anti-influenza_Chain
  source 1..1695: mol_type = other RNA
atgaaggtgaaactgctcgtccttctgtgcaccttcacagccacttacgctgacacgatctgtattggctatcacgcaaacaatagcaccgatacagttgacactgtgttggagaagaacgtaaccgtgacacattccgtcaatttactggaaaactctcacaatgggaaactatgcctcctgaagggaatagcgccccttcagctgggtaactgttcagtggccggctggatcttggggaatcctgagtgcgaactcctgattagtaaagagagctggtcctacatcgttgaaaagccaaacccggagaatggaacctgttatcccggccattttgctgattacgaggaactgagagagcaactctcttcggtgagctcattcgaaaggtttgagattttccctaaggagagttcctggccaaaccacactgtcacaggtgtgtctgccagctgctcccataatggggaatcaagtttttatcggaacttactgtggcttaccggcaaaaatggattgtaccccaacctgagcaagtcttatgcaaataacaaagagaaggaagttctagtactctggggcgtgcaccaccctccaaacatcggggaccagaaaacgctgtaccatactgagaatgcctacgtctccgtggtgtcaagccactatagtcgcaagttcacccccgaaatagctaagcgacctaaagtccgtgatcaggagggaagaatcaactactattggacacttctggagccaggtgacactattatctttgaagcaaatggcaacttgattgccccgaggtacgctttcgccctctctcgggggtttggatccggcatcataaatagcaacgcgcccatggataagtgtgacgcaaaatgccagacccctcaaggtgccattaattcgtctctgccattccagaacgttcatcccgtgacaatcggggagtgtcctaagtatgtacgctccgctaaattaagaatggtgaccggactgaggaatattccatcaatccagagtcggggcctctttggcgccatcgcagggttcattgaaggaggttggacgggcatggtcgatgggtggtacggatatcaccaccagaacgagcaaggcagcggttacgctgccgaccagaagtccactcagaatgcgataaacgggatcacaaataaagtgaactctgttattgaaaagatgaatacccagtttactgccgtgggcaaggagttcaacaaacttgagcgccgaatggaaaacctgaataagaaagtcgatgacggattcatcgatatatggacatacaacgcagagttgctagtgctgctcgaaaatgagagaaccctggactttcatgacagcaacgtaaagaatctttatgaaaaagttaagtcacaactgaagaacaatgctaaagagattggcaacgggtgcttcgagttttaccacaagtgtaatgatgaatgcatggagagtgtgaaaaacggaacgtatgactaccccaagtattccgaagagagcaaattgaatagggagaagatcgatggtgtcaagctcgaatctatgggcgtgtaccagatcctggccatttattcaaccgtcgctagtagcttagtgctgctagtttccctcggggccatctctttctggatgtgctcgaacggaagcctgcagtgtcggatttgcata

SEQ ID NO: 28336 - RNA, 1695 nt, synthetic construct
  misc_feature 1..1695: note = derived and/or modified sequence opt3 from anti-influenza_Chain
  source 1..1695: mol_type = other RNA
atgaaggtgaaactgctcgtccttctgtgcaccttcacagccacttacgctgacacgatctgtattggctatcacgcaaacaatagcaccgatacagttgacactgtgttggagaagaacgtaaccgtgacacattccgtcaatttactggaaaactctcacaatgggaaactatgcctcctgaagggaatagcgccccttcagctgggtaactgttcagtggccggctggatcttggggaatcctgagtgcgaactcctgattagtaaagagagctggtcctacatcgttgaaaagccaaacccggagaatggaacctgttatcccggccattttgctgattacgaggaactgagagagcaactctcttcggtgagctcattcgaaaggtttgagattttccctaaggagagttcctggccaaaccacactgtcacaggtgtgtctgccagctgctcccataatggggaatcaagtttttatcggaacttactgtggcttaccggcaaaaatggattgtaccccaacctgagcaagtcttatgcaaataacaaagagaaggaagtgctagttctctggggcgtgcaccaccctccagacatcggggatcagaaaacgctgtaccatactgagaacgcctacgtctccgtggtgtcaagccactatagtcgcaagttcacccccgaaatagctaagcgacctaaagtccgtgaccaggagggaagaatcaattactattggacacttctggagccaggtgatactattatctttgaagcaaacggcaatttgattgccccgaggtacgctttcgccctctctcgggggtttggatccggcatcataaacagcaatgcgcccatggacaagtgtgatgcaaaatgccagacccctcaaggtgccattaactcgtctctgccattccagaatgttcatcccgtgacaatcggggagtgtcctaagtatgtacgctccgctaaattaagaatggtgaccggactgaggaacattccatcaatccagagtcggggcctctttggcgccatcgcagggttcattgaaggaggttggacgggcatggtcgacgggtggtacggatatcaccaccagaatgagcaaggcagcggttacgctgccgatcagaagtccactcagaacgcgataaatgggatcacaaacaaagtaaattctgttattgaaaagatgaacacccagtttactgccgtgggcaaggagttcaataaacttgagcgccgaatggaaaacctgaacaagaaagtcgacgatggattcatcgacatatggacatacaatgcagagttgctagtgctgctcgaaaacgagagaaccctggactttcatgatagcaatgtaaagaacctttatgaaaaagttaagtcacaactgaagaataacgctaaagagattggcaatgggtgcttcgagttttaccacaagtgtaacgacgaatgcatggagagtgtgaaaaatggaacgtatgattaccccaagtattccgaagagagcaaattgaacagggagaagatcgacggtgtcaagctcgaatctatgggcgtgtaccagatcctggccatttattcaaccgtcgctagtagcttagtgctgctagtttccctcggggccatctctttctggatgtgctcgaatggaagcctgcagtgtcggatttgcata

SEQ ID NO: 28337 - RNA, 1695 nt, synthetic construct
  misc_feature 1..1695: note = derived and/or modified sequence opt3 from anti-influenza_Chain
  source 1..1695: mol_type = other RNA
atgaaggtgaaactgctcgtccttctgtgcaccttcacagccacttacgctgacacgatctgtattggctatcacgcaaacaatagcaccgatacagttgacactgtgttggagaagaacgtaaccgtgacacattccgtcaatttactggaaaactctcacaatgggaaactatgcctcctgaagggaatagcgccccttcagctgggtaactgttcagtggccggctggatcttggggaatcctgagtgcgaactcctgattagtaaagagagctggtcctacatcgttgaaaagccaaacccggagaatggaacctgttatcccggccattttgctgattacgaggaactgagagagcaactctcttcggtgagctcattcgaaaggtttgagattttccctaaggagagttcctggccaaaccacactgtcacaggtgtgtctgccagctgctcccataatggggaatcaagtttttatcggaacttactgtggcttaccggcaaaaatggattgtaccccaacctgagcaagtcttatgcaaataacaaagagaaggaagttctagtactctggggcgtgcaccaccctccaaacatcggggaccagaaagccctgtaccatacggagaatgcttacgtctccgtggtgtcaagccactatagtcgcaagttcactcccgaaatagcaaagcgacctaaagtccgtgatcaggagggaagaatcaactactattggacccttctggagccaggtgacacaattatctttgaagccaatggcaacttgattgctccgaggtacgccttcgcgctctctcgggggtttggatccggcatcataaatagcaacgcacccatggataagtgtgacgccaaatgccagactcctcaaggtgctattaattcgtctctgccattccagaacgttcatcccgtgaccatcggggagtgtcctaagtatgtacgctccgccaaattaagaatggtgacaggactgaggaatattccatcaatccagagtcggggcctctttggcgcaatcgctgggttcattgaaggaggttggaccggcatggtcgatgggtggtacggatatcaccaccagaacgagcaaggcagcggttacgccgcggaccagaagtccacgcagaatgccataaacgggatcactaataaagtgaactctgttattgaaaagatgaatacacagtttaccgcagtgggcaaggagttcaacaaacttgagcgccgaatggaaaacctgaataagaaagtcgatgacggattcatcgatatatggacttacaacgctgagttgctagtgctgctcgaaaatgagagaacactggactttcatgacagcaacgtaaagaatctttatgaaaaagttaagtcacaactgaagaacaatgccaaagagattggcaacgggtgcttcgagttttaccacaagtgtaatgatgaatgcatggagagtgtgaaaaacggaacctatgactaccccaagtattccgaagagagcaaattgaatagggagaagatcgatggtgtcaagctcgaatctatgggcgtgtaccagatcctggctatttattcaacggtcgccagtagcttagtgctgctagtttccctcggggcaatctctttctggatgtgctcgaacggaagcctgcagtgtcggatttgcata

SEQ ID NO: 28338 - RNA, 1695 nt, synthetic construct
  misc_feature 1..1695: note = derived and/or modified sequence opt3 from anti-influenza_Chain
  source 1..1695: mol_type = other RNA
atgaaggccaaactgctcgtgcttctgtgcaccttcacagctacttacgcagacacgatctgtattggctatcacgccaacaatagcaccgatacagtcgacactgttttggagaagaacgtgaccgtaacacattccgtgaatttactggaagattctcacaacgggaaactatgcctcctgaagggaatagcgccccttcagctgggtaattgttcagtcgctggctggatcttggggaaccctgagtgcgaactcctgattagtaaagagagctggtcctacatcgtggaaaccccaaatccggagaacggaacttgttatcccggctactttgccgactatgaggaactgagagagcaactctcttcggttagctcattcgaaaggtttgagattttccctaaggagagttcctggccaaatcatacagtgaccggtgtctctgcaagctgctcccacaacgggaagtcaagtttttaccggaatttactgtggcttacgggcaaaaacggattgtatcccaatctgagcaagtcttacgtgaacaataaagaaaaggaggtgctagttctctggggcgtgcatcaccctccaaacatcgggaaccagcgcgccctgtaccacactgaaaatgcttatgtctccgtggtgtcaagccattacagtcgacgtttcacccccgagatagcaaaaagacctaaggtcagggatcaggaaggacggatcaactattactggacacttctggagccaggtgacactattatctttgaggccaatggcaacttgattgctccgtggtatgccttcgcgctctctcgcgggtttggatccggcatcataaccagcaatgcacccatggatgaatgtgacgccaagtgccagacacctcaaggtgctattaactcgtctctgccattccagaatgttcaccccgtgaccatcggggagtgtcctaaatacgtaagatccgccaagttaaggatggtgacgggactgcggaacattccatcaatccagagtcgcggcctctttggcgcaatcgctgggttcattgaaggaggttggactggcatggtcgatgggtggtatggataccatcaccagaatgagcaaggcagcggttacgccgcggaccagaaatccacacagaacgccataaatgggatcaccaacaaggtaaattctgttattgaaaagatgaacactcagtttacagcagtgggcaaagagttcaataaacttgagcgaagaatggaaaacctgaacaagaaggtcgatgacggattcttggatatctggacctataatgctgagctactggtgctcctggaaaacgagaggacgcttgactttcacgacagcaatgttaaaaacctgtacgaaaaggtaaaatcacaattgaagaataacgccaaagagataggcaatgggtgcttcgagttttatcataagtgtaacaatgaatgcatggagagtgtgaagaacggaacctacgattatcccaaatactccgaagagagcaagctcaatcgggagaaaattgacggtgtcaagctggaatctatgggcgtgtatcagatcttagctatctactcaacagtcgccagtagcctggtgctactcgtttccctgggggcaatttctttctggatgtgctcgaacggaagccttcagtgtcgtatctgcatt

SEQ ID NO: 28339 - RNA, 1695 nt, synthetic construct
  misc_feature 1..1695: note = derived and/or modified sequence opt3 from anti-influenza_Chain
  source 1..1695: mol_type = other RNA
atgaaggtgaaactgctcgtccttctgtgcaccttcacagccacttacgctgacacgatctgtattggctatcacgcaaacaatagcaccgatacagttgacactgtgttggagaagaacgtaaccgtgacacattccgtcaatttactggaagattctcacaacgggaaactatgcctcctgaagggaatagcgccccttcagctgggtaattgttcagtggccggctggatcttggggaaccctgagtgcgaactcctgattagtagagagagctggtcctacatcgttgaaaaaccaaatccggagaacggaacctgttatcccggccattttgctgactacgaggaactgagggagcaactctcttcggtgagctcattcgaacggtttgagattttccctaaggagagttcctggccaaatcacactacaaccggtgtctctgccagctgctcccataacggggaatcaagtttttataagaatttactgtggcttacgggaaagaacggcttgtaccccaatctgagcaagtcttatgcaaacaataaagagaaggaagtgctagtactctggggcgttcaccaccctccaaacatcggggatcagcgcgccctgtaccataaagagaacgcttacgtgtccgtcgtgtcaagccactatagtcgaaagttcactcccgaaatagcaaagcgtcctaaagtgagagaccaggagggaaggatcaattactattggacccttctggagccaggtgatacaattatctttgaagccaacggcaatttgattgctccgcggtacgccttcgcgctctctcgcgggtttggatccggcatcataaacagcaatgcacccatggacgagtgtgatgccaagtgccagactcctcaaggtgctattaactcgtctctgccattccagaatgtccatcccgttaccatcggggaatgtcctaaatatgtgagatccgccaagttaaggatggtaacaggactgcggaacattccatcaatccagagtcgcggcctctttggcgcaatcgctgggttcattgagggaggttggaccggcatggtggacgggtggtacggatatcaccaccagaatgaacaaggcagcggttacgccgcggatcagaaatccacgcagaacgccataaatgggatcactaacaaggtcaattctgtgattgagaaaatgaacacacagtttaccgcagttggcaaggagttcaataaacttgaacgaagaatggagaacctgaacaaaaaggtggacgatggattcatcgacatatggacttacaatgctgaattgctagtcctgctcgagaacgaaaggacactggactttcatgatagcaatgtgaaaaacctttatgagaaggtaaaatcacaactgaagaataacgccaaggagattggcaatgggtgcttcgaattttaccacaaatgtaacgacgagtgcatggaaagtgttaagaatggaacctatgattaccccaaatattccgaggagagcaagttgaaccgggagaaaatcgacggtgtgaagctcgaatctatgggcgtctaccagatcctggctatttattcaacggtggccagtagcttagtcctgctagtgtccctcggggcaatctctttctggatgtgctcgaatggaagcctgcagtgtcgtatttgcata

SEQ ID NO: 28340 - RNA, 1677 nt, synthetic construct
  misc_feature 1..1677: note = derived and/or modified sequence opt3 from anti-influenza_Chain
  source 1..1677: mol_type = other RNA
gacaagatctgcattggctaccagagcaccaactccacagagactgtggatacgctgaccaaaacaaatgtccccgttactcaagccaaggaactccttcacaccgagcataacgggatgctgtgtgctacaaatttgggacaccctttaatactggatacctgcactatcgaaggtctaatttatggcaacccatcttgtgacctcctgcttgggggaagagagtggtcatacatcgtggaaaggccgagtgcagtaaatggcatgtgctatcccggtaacgtggagaatctggaggaattgcggctcctgttcagctccgcctcttcgtaccagcgcgtccagatttttcctgacacaatctggaacgtgacctattcagggacgagcagtgcgtgttccaattctttctaccgaagcatgcgttggctgactcagaaagataacacctatccagttcaagacgctcagtacacaaataacagaggaaagtccatactctttatgtggggcatcaatcatccccctactgataccgtgcagacaaacttatacaccaggacggacactacaacctcagtcactacagaggatattaatcgggccttcaaaccagtgatcggcccccgccctctggtaaacgggcttcagggaagaattgactattactggagtgttttgaagccaggtcaaaccctgagggtgcggagcaacggcaatctaatcgcaccgtggtatgggcacatactctctggagaatcccatggccgcattctgaagtcagatcttaacagcggtaattgcgtcgtgcagtgtcagacggagcgagggggactgaacaccacattgccctttcacaatgtgagtaaatacgccttcggcaactgccctaagtatgtcggcgttaaatctctcaagctggctgtggggatgagaaatgtaccagcaaggtccagccggggattatttggtgccatcgctggcttcattgaagggggatggcccggcctggtggccggttggtacgggtttcagcactcgaacgaccaaggcgtcggaatggcggcagatcgtgactctactcagaaagccatcgacaagatcacctccaaggtgaataacattgttgataaaatgaataagcagtatgagataatcgaccatgagttctcagaaattgagacacgcctcaacatgatcaataacaaaatagatgaccaaattcaggatatctgggcttacaatgccgaacttctggtgttgctagagaaccagaagactctggacgagcacgatgcaaacgtcaataacctctacaataaagtgaagagagctctgggcagtaacgccatggaagacgggaaaggatgttttgagctttatcataagtgcgatgacaggtgtatggaaaccatccggaatggtacatacaaccgaggcaagtataaagaggaaagccgcctggagagacagaagattgagggggtaaaattggaatccgagggaacctacaagtctggcaggctcgttcctcggggtagcccagggtcaggctatatccccgaagcgccgcgcgatggacaagcctacgtgagaaaagacggcgagtgggtcctgttaagtactttcctggggaagcctattcccaatccactactcggactggactccacgggt

SEQ ID NO: 28341 - RNA, 1677 nt, synthetic construct; identical to SEQ ID NO: 28340
  misc_feature 1..1677: note = derived and/or modified sequence opt3 from anti-influenza_Chain
  source 1..1677: mol_type = other RNA

SEQ ID NO: 28342 - RNA, 1695 nt, synthetic construct; identical to SEQ ID NO: 28333
  misc_feature 1..1695: note = derived and/or modified sequence opt3 from anti-influenza_Chain
  source 1..1695: mol_type = other RNA

SEQ ID NO: 28343 - RNA, 1695 nt, synthetic construct; identical to SEQ ID NO: 28330
  misc_feature 1..1695: note = derived and/or modified sequence opt3 from anti-influenza_Chain
  source 1..1695: mol_type = other RNA

SEQ ID NO: 28344 - RNA, 1695 nt, synthetic construct; identical to SEQ ID NO: 28331
  misc_feature 1..1695: note = derived and/or modified sequence opt3 from anti-influenza_Chain
  source 1..1695: mol_type = other RNA

SEQ ID NO: 28345 - RNA, 1695 nt, synthetic construct; identical to SEQ ID NO: 28332
  misc_feature 1..1695: note = derived and/or modified sequence opt3 from anti-influenza_Chain
  source 1..1695: mol_type = other RNA

SEQ ID NO: 28346 - RNA, 1695 nt, synthetic construct; identical to SEQ ID NO: 28334
  misc_feature 1..1695: note = derived and/or modified sequence opt3 from anti-influenza_Chain
  source 1..1695: mol_type = other RNA

SEQ ID NO: 28347 - RNA, 1695 nt, synthetic construct; identical to SEQ ID NO: 28335
  misc_feature 1..1695: note = derived and/or modified sequence opt3 from anti-influenza_Chain
  source 1..1695: mol_type = other RNA

SEQ ID NO: 28348 - RNA, 1695 nt, synthetic construct; identical to SEQ ID NO: 28336
  misc_feature 1..1695: note = derived and/or modified sequence opt3 from anti-influenza_Chain
  source 1..1695: mol_type = other RNA

SEQ ID NO: 28349 - RNA, 1695 nt, synthetic construct; identical to SEQ ID NO: 28337
  misc_feature 1..1695: note = derived and/or modified sequence opt3 from anti-influenza_Chain
  source 1..1695: mol_type = other RNA

SEQ ID NO: 28350 - RNA, 1695 nt, synthetic construct; identical to SEQ ID NO: 28338
  misc_feature 1..1695: note = derived and/or modified sequence opt3 from anti-influenza_Chain
  source 1..1695: mol_type = other RNA

SEQ ID NO: 28351 - RNA, 1695 nt, synthetic construct; identical to SEQ ID NO: 28339
  misc_feature 1..1695: note = derived and/or modified sequence opt3 from anti-influenza_Chain
  source 1..1695: mol_type = other RNA

SEQ ID NO: 28352 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgttcgctcagaaactgcccggcaacgacaattccacagcaactttgtgtttagggcaccatgccgtccctaacggaacgatcgttaagaccattacaaatgatcaaatcgaggtgactaacgcgaccgaactggtacagtcttcaagtacaggtggcatttgcgacagcccacaccagatcctagatggggagaattgtaccctcatagacgctctgcttggagatccgcagtgcgacggctttcaaaacaaaaagtgggatctgttcgtggaaagatccaaagcctattctaattgttacccctatgacgtccctgattacgcatcgttgaggtcactcgtggccagcagtggtactctggagtttaacaatgaatccttcaactggacaggggttacccagaatggaacgtctagcgcttgcaagcggcgctccaacaattcatttttcagtcgactgaactggctcactcatttaaagtttaaatatccagcactgaatgtgaccatgcccaacaacgagaagttcgacaaactttacatctggggcgtccaccatcctggcacagataatgaccagattagcttgtatgcccaggcttctgggcgtatcactgtgtccaccaagagatcacaacagacagtaattccaagcatcggaagtaggccccggatacgcgatgttccttctagaatttccatctactggaccattgtgaaaccaggtgacatcctgctaatcaacagcacgggcaatctcattgccccgagggggtactttaagatacggtcgggaaagtcttccatcatgcgctcagacgcgcccattggcaaatgtaacagtgagtgcatcactcctaatggtagcataccaaacgataagcccttccagaatgtcaaccgaattacatatggggcatgtcctagatacgtgaaacagaataccctgaaacttgccactggaatgaggaacgtgccagaaaaacaaacacggggcatctttggcgctatcgccgggttcattgagaatggatgggaaggtatggtcgacggctggtatgggtttcgtcaccagaactccgagggaaccggccaggcagctgatctgaagtctacgcaagccgcgatcaatcagattaacggtaaattgaatcgcctcatagggaagaccaacgagaagttccaccagatcgaaaaagagttcagcgaagttgagggcaggattcaggacctggaaaagtacgtggaggatacaaaaatcgacttatggtcatataacgccgagctgctcgtagcacttgaaaatcaacatactatcgatctgaccgacagtgagatgaacaagttgtttgaaagaacaaagaagcagctacgggagaatgctgaagatatgggaaacggctgcttcaagatttaccacaaatgtgacaatgcctgcatagggtccatccgaaacggaacttatgatcatgacgtgtaccgcgacgaggctctgaataacagatttcagattaagggtgtcgagctcaaaagcggctacaaggattggatcctgtggatttctttcgccatctcatgctttcttctgtgtgtggcattgctcgggttcataatgtgggcctgccagaaaggaaatatcaggtgtaacatttgcatc

SEQ ID NO: 28353 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgtccgctcagaaattccccggcaacgacaattctacagcaactctgtgtttggggcaccatgccgtccctaacggaacgatcgttaagaccattacaaatgatcaaatcgaggtgactaacgcgaccgaattagtacagtcaagtagcacaggtgagatttgcgactccccacaccagatcctggatggcgaaaattgtaccctaatagacgctctcctgggggatccgcagtgcgacggatttcaaaacaaaaagtgggatcttttcgtggagagatctaaagcctattcgaattgttacccctatgacgtccctgattacgcatcactgaggagcttggtggccagttccggcactctcgaatttaacaatgagtctttcaactggacaggtgttacccagaatgggacgagctccgcttgcatccggcgctcaaacaatagctttttcagccgactgaactggctgactcatctcaagtttaagtatccagcattaaatgtgaccatgcccaacaacgaggagttcgacaaactgtacatttggggagtccaccatcctggcacagataatgaccagatctttctttatgcccaggcttctggccgtattactgtgtccaccaagagatcacaacagacagtaatcccaaacataaggagccggccccgcgttagaaatattcctagtaggatctctatttactggaccatcgtgaaaccaggggatatcttgctgattaactccacgggaaatctaatagccccgcggggttacttcaagatccgcagcggcaaatcgtctattatgcgatccgacgcgcccatcgggaagtgtaactcagaatgcataactcctaatggaagtattccaaacgacaagccctttcagaatgtcaacagaatcacatatggcgcatgtcctaggtacgtgaaacagaataccctcaagctggccactggtatgcggaacgtgccagaaaaacaaacacgtgggatcttcggagctattgccggctttatcgagaatggctgggaggggatggtcgatggatggtatggtttccgccaccagaacagcgaaggcattgggcaggcagctgaccttaagtccacccaagccgcgatagatcagatcaatggaaaactgaacagattgattggcaagacgaacgagaaattccaccagatcgaaaaggagttttctgaagttgagggtaggatccaggacctcgagaagtacgtggaagataccaaaattgacctgtggagctataatgccgagttactggtagcactcgaaaaccaacatacaatagatcttactgactcagagatgaataagctgttcgagaaaaccaagaaacagttgcgggaaaacgctgaggatatggggaatggctgctttaagatctaccacaagtgtgacaacgcctgcattggaagtatccgaaatggcacatatgatcatgacgtgtaccgcgacgaagctctaaacaatagattccagattaaaggggtcgagctgaagtccggatacaaagattggatcctctggataagttttgccatctcttgcttcctgctttgtgtggcactgttgggttttattatgtgggcctgccagaagggcaacatcaggtgtaatatttgcatc

SEQ ID NO: 28354 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgttcgctcagaaactgcccggcaacgacaattccacagcaactttgtgtttagggcaccatgccgtccctaacggaacgatcgttaagaccattacaaatgatcaaatcgaggtgactaacgcgaccgaactggtacagtcttcaagtacaggtgagatttgcgacagcccacaccagatcctagatggcgaaaattgtaccctcatagacgctctgcttggggatccgcagtgcgacggatttcaaaacaaaaagtgggatctgttcgtggagagatccaaagcctattctaattgttacccctatgacgtccctgattacgcatcgttgaggtcactcgtggccagcagtggcactctggaatttaagaacgagtccttcaattggacaggtgttacccagaacgggacgtctagcgcttgcatccggcgctccaataactcatttttcagtcgactgaattggctcactcatttaaagtttaaatatccagcactgaacgtgaccatgcccaataaggagaaattcgacaaactttacatttggggagtccaccatcctggcacagataacgaccagatctttttgtatgcccaggctagcggccgtattactgtgtctaccaagagatcccaacagacagtaatcccaaacatagggtcaaggctgcgggttcgcgatattcccagcagaatcagtatttactggaccatcgtgaagcctggagacatcctactcattaattctacgggtaacctgatagccccaaggggctacttcaagatccggtccgggaaaagctcgattatgcgctctgacgcgccgatcggaaagtgtaattccgaatgcataactcccaacggctcaattcctaatgataaaccatttcagaacgtcaatcgaatcacatatggtgcatgtcccagatacgtgaagcagaacacccttaaactggccactgggatgaggaatgtgcctgagaagcaaacacggggaatcttcggcgctattgccggctttatcgaaaacgggtgggagggaatggtcgacggttggtatggcttccgtcaccagaatagtgaggggaccggacaggcagctgatttgaaaagcacgcaagccgcgattgaccagataaacggcaagctcaatcgcctgatcggtaagaccaacgaaaaattccaccagattgagaaggaattttccgaggttgaagggagaatccaggatttagagaaatacgtggaggacacaaagatcgatctgtggtcttataatgccgaactccttgtagcactggagaaccaacatactattgacttgaccgatagcgaaatgaacaaactattcgagaagacaaagaaacagctgagggaaaatgctgaggacatgggcaacggatgctttaagatataccacaaatgtgataatgcctgcatcggctcaattcggaacgggacttatgaccatgacgtgtaccgagatgaggctctcaataaccgcttccagatcaagggagtcgaactgaaaagtggttacaaggactggattctttggatctcctttgccataagctgcttcctgttgtgtgtggcactcctgggctttatcatgtgggcctgccagaaggggaatattagatgtaacatctgcatt

SEQ ID NO: 28355 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgttcgctcagaaactgcccggcaacgacaattccacagcaactttgtgtttagggcaccatgccgtccctaacggaacgatcgttaagaccattacaaatgatcaaatcgaggtgactaacgcgaccgaactggtacagtcttcaagtacaggtgagatttgcgacagcccacaccagatcctagatggcgaaaattgtaccctcatagacgctctgcttggggatccgcagtgcgacggatttcaaaacaaaaagtgggatctgttcgtggagagatccaaagcctattctaagtgttacccctatgacgtccctgattacgcatcgttgaggtcactcgtggccagcagtggcactctggaatttaataacgagtccttcaattggacaggtgttacccagaacgggacgtctagcgcttgcatccggcgctccaataactcatttttcagtcgactgaattggctcactcatttaaagtttaaatatccagcactgaacgtgaccatgcccaataacgagaagttcgacaaactttacatttggggagtccaccatcctggcacagataacgaccagatctttttgtatgcccaggctagcggccgtattactgtgtctaccaagagatcccaacagacagtaatcccaaatatagggtcaaggccccgggttcgcgatattcctagcagaatcagtatttactggaccatcgtgaaaccaggagacatcctgctaattaactctacgggtaatctcatagccccgaggggctacttcaagatccggtccggaaagagctcgattatgcgctctgacgcgcccatcgggaaatgtaactccgaatgcataactcctaatggctcaattccaaacgataagccctttcagaatgtcaaccgaatcacatatggtgcatgtcctagatacgtgaaacagaataccctgaagctggccactgggatgaggaacgtgccagagaaacaaacacggggaatcttcggcgctattgccggctttatcgaaaatgggtgggagggaatggtcgacggttggtatggcttccgtcaccagaacagtgaggggattggacaggcagctgatcttaagagcacccaagccgcgatagaccagatcaatggcaaattgaaccgcctcattggtaagacgaatgaaaagttccaccagatcgagaaagaattttccgaggttgaagggagaatccaggatctggagaagtacgtggaggacaccaaaattgatttatggtcttataacgccgaactgctcgtagcacttgagaaccaacatacaatagacctgactgatagcgaaatgaataagttgttcgagaaaaccaagaagcagctaagggaaaacgctgaggacatgggcaatggatgctttaaaatctaccacaagtgtgataacgcctgcattggctcaatccggaatgggacatatgaccatgacgtgtaccgagatgaggctctgaacaatcgcttccagattaaaggagtcgaactcaagagtggttacaaagactggatcctgtggatatcctttgccatcagctgcttccttctgtgtgtggcattgctcggctttattatgtgggcctgccagaaggggaacatcagatgtaatatttgcatc

SEQ ID NO: 28356 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgttcgctcagaaactgcccggcaacgacaattccacagcaactttgtgtttagggcaccatgccgtccctaacggaacgatcgttaagaccattacaaatgatcaaatcgaggtgactaacgcgaccgaactggtacagtcttcaagtacaggtgagatttgcgacagcccacaccagatcctagatggcgaaaattgtaccctcatagacgctctgcttggggatccgcagtgcgacggatttcaaaacaaaaagtgggatctgttcgtggagagatccaaagcctattctaattgttacccctatgacgtccctgattacgcatcgttgaggtcactcgtggccagcagtggcactctggaatttaacaatgagtccttcaactggacaggtgttacccagaatgggacgtctagcgcttgcatccggcgctccaacaattcatttttcagtcgactgaactggctcactcatttaaagtttaagtatccagcactgaatgtgaccatgcccaacaacgagaaattcgacaaactttacatttggggagtccaccatcctggcacagataatgaccagatctttttgtatgcccaggctagcggccgtattactgtgtctaccaagagatcccaacagacagtaatcccaaacatagggtcaaggccccgggttcgcaatattcctagcagaatcagtatttactggaccatcgtgaagccaggagatatcctgctaattaactctacgggtaatctcatagccccgaggggctacttcaaaatccggtccggaaagagctcgattatgcgctctgacgcgcccatcgggaagtgtaactccgaatgcataactcctaatggctcaattccaaacgacaaaccctttcagaatgtcaaccgaatcacatatggtgcatgtcctagatacgtgaagcagaataccctgaaacttgccactgggatgaggaacgtgccagagaagcaaacacggggaatcttcggcgctattgccggctttatcgaaaatgggtgggagggaatggtcgatggttggtatggcttccgtcaccagaacagtgaggggattggacaggcagctgacctgaaaagcacccaagccgcgatagatcagatcaatggcaagttgaaccgcctcattggtaaaacgaacgaaaagttccaccagatcgagaaggaattttccgaggttgaagggagaatccaggacctggagaaatacgtggaggataccaagattgacttatggtcttataatgccgaactgctcgtagcacttgagaaccaacatacaatagatctgactgacagcgaaatgaataaattgttcgagaagaccaaaaagcagctaagggaaaacgctgaggatatgggcaatggatgctttaagatctaccacaaatgtgacaacgcctgcattggctcaatccggaatgggacatatgatcatgacgtgtaccgagacgaggctctgaacaatcgcttccagattaagggagtcgaactcaaaagtggttacaaggattggatcctgtggatatcctttgccatcagctgcttccttctgtgtgtggcattgctcggctttattatgtgggcctgccagaaagggaacatcagatgtaatatttgcatc

SEQ ID NO: 28357 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgttctcccagaaactgcccggcaacgacaattctacagctactttgtgtttagggcaccatgcagtccctaacggaacgatcgttaagaccattacaaatgatcaaatcgaggtgactaacgccaccgaactggtacagtcaagtagcacaggtggcatttgcgactccccacaccagatcctagatggggagaattgtaccctcatagacgcgctgcttggagatccgcagtgcgacggctttcaaaacaaaaagtgggatctgttcgtggaaagatctaaggcttattcgaattgttacccctatgacgtccctgattacgcctcattgaggagcctcgtggcaagttccggtactctggagtttaacaatgaatctttcaactgggccggggttacacagaatggaaccagctccgcttgcaagcggcgctcaaacaagagctttttcagtcgactgaattggctcacgcatttaaaatataagtacccagcactgaacgtgactatgcccaataacgagaaatttgacaaactttatatctggggcgtccaccatcctgtgaccgattctgaccagatttccttgtacgcccaggcttcaggccgtatcacagtaagcactaaaagaagtcaacagaccgttattccaaacatcgggtacaggccccgggtgcgcgatatatcttccagaattagcatctattggacaattgtcaagcctggagacatcctgctaatcaattcgaccggtaacctcattgccccaaggggctacttcaagatacggtctgggaaatcctcaatcatgcgcagtgacgcgccgattggaaagtgtaatagcgagtgcatcacgcccaacggctccatacctaatgataaaccatttcagaacgtgaatcgaattacttatggtgcatgtcccagatacgtgaagcagaacacactgaaacttgccaccgggatgaggaatgtccctgaaaagcaaactcggggaatcttcggcgctatcgccggctttattgagaacgggtgggaaggaatggttgacggttggtatggcttccgtcaccaaaattctgaggggacaggacaggcagctgatctgaaaagcacccaggccgcgatcaaccagattaatggcaagttgaaccgcctcataggtaagacgaatgagaaatttcaccagatcgaaaaggagttctcagaagtggaggggaggattcaggacctggaaaaatacgtagaggataccaagatcgacttatggagttataacgccgagctgctcgtggcacttgaaaaccaacatacaatcgatctgactgactccgagatgaataaattgttcgaaagaaccaagaagcagctacgggagaacgctgaagatatgggcaatggatgctttaaaatttaccacaagtgtgacaacgcctgcatagagagcatccgaaatggcacatacgatcatgacgtctatcgcgacgaggctctgaacaatagattccagattaaaggggtggaactcaagtctggatacaaagattggatcctgtggatttcatttgccatcagttgcttccttctgtgtgttgcattgctcggttttataatgtgggcctgccagaagggcaacatcaggtgtaatatttgcatc

SEQ ID NO: 28358 - RNA, 1698 nt, synthetic construct
  misc_feature 1..1698: note = derived and/or modified sequence opt3 from anti-influenza_Chain
  source 1..1698: mol_type = other RNA
atgaagaccatcattgccctgagctacatactctgccttgtgttcgctcagaaactgcccggcaacgacaattccacagcaactttgtgtttagggcaccatgccgtccctaacggaacgatcgttaagaccattacaaatgatcaaatcgaggtgactaacgcgaccgaactggtacagtcttcaagtacaggtggcatttgcgacagcccacaccagatcctagatggggagaattgtaccctcatagacgctctgcttggagatccgcagtgcgacggctttcaaaacaaaaagtgggatctgttcgtggaaagatccaaagcctattctaattgttacccctatgacgtccctgattacgcatcgttgaggtcactcgtggccagcagtggtactctggagtttaacgacgaatccttcaattggacaggggttacccagaacggaacgtctagctcctgcaagcggcgctcaaataacagctttttcagccgactgaattggctcactcatttaaagtttaaatatccagctctgaacgtgaccatgcccaataacgagaagttcgataaactttacatctggggcgtccaccatcctgtgacagacaacgatcagatttttctttatgcacaggcctctggccgtatcactgtatccaccaagagatcacaacagacagttattccaaatatcgggagcaggccccggatacgcaacattcctagtagaatctctatttactggaccatcgtgaaaccaggagacatcctgctaattaattccacgggtaacctcatagctccgaggggctacttcaagatccggagcgggaagtcgtctattatgcgctccgacgcccccatcggaaaatgtaattcagagtgcataactcctaacggcagtattccaaatgataagccctttcagaacgtcaatcgaatcacatatggtgcgtgtcctagatacgtgaaacagaacaccctgaagttggcaactgggatgaggaatgtgccagaaaaacaaacacggggaatcttcggcgccattgctggctttatcgagaacgggtgggaaggaatggtcgacggttggtatggcttccgtcaccagaatagcgaggggattggacaggccgcagatctgaagtccacccaagctgccataaaccagatcaatggcaaattgaaccgcctcattggtaagacgaacgagaagttccaccagatcgaaaaagagttttctgaagttgaggggagaatccaggacctggaaaagtacgtggaggataccaaaattgacttatggagctataatgcggagctgctcgtagcccttgaaaaccaacatacaatagatctgactgactcagagatgaataagttgttcgaaaggaccaaaaagcagctacgggagaacgcagaagatatgggcaatggatgctttaagatctaccacaaatgtgacaacgcttgcattggcagtatccgaaatgggacatatgatcatgacgtgtaccgcgacgaggccctgaacaatagattccagattaagggagtcgagctcaaatccggttacaaggattggatcctgtggataagttttgctatctcttgcttccttctgtgtgtggccttgctcggctttattatgtgggcatgccagaaagggaacatcaggtgtaatatttgcatc

SEQ ID NO: 28359 - RNA, 1698 nt, synthetic construct
  misc_feature 1..1698: note = derived and/or modified sequence opt3 from anti-influenza_Chain
  source 1..1698: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaaattatgtgatctggacggagtcaaacccctaattctcagagattgctcagtggccggttggctgcttggcaaccctatgtgtgacgagttcatcaatgttccagaatggagttatatagtggagaaggcgaacccgacaaatgatctgtgctaccccgggagctttaacgactatgaggaattgaagcatctcctgtccaggatcaatcacttcgagaaaattcagatcattcctaagtcttcgtggtcagatcatgaagctagcagtggagtctcctctgcctgtccatacctgggcagcccctcctttttccggaacgtggtatggctcatcaaaaagaactcaacttatcctaccattaaaaagagttacaataatacaaaccaggaggacttactggttctttggggtatacaccacccaaatgatgcagccgagcaaacccgcttgtatcagaaccccactacatacatcagcattgggacctctacgctgaaccagcggctagtgcctaagatcgctactcgttccaaagtcaatggacagtcaggcagaatggaatttttctgggcaatcctcaagccaaacgacgccattaattttgagagcaacggcaatttcatagctccggaatacgcctataaaatcgtgaagaaaggggatagtgcgattatgaagtctgagctggaatacggaaactgcaataccaaatgtcaaacacccatgggtgcaatcaactccagcatgccttttcataatatacacccacttactattggcgagtgccccaagtatgtgaagtcgaacaggctggtcttggccaccgggctccgaaattctcctcagcgcgagtccagaaggaaaaagcggggactgttcggcgctatcgccggttttatcgaagggggatggcagggcatggttgacggctggtacgggtatcatcactcaaacgagcagggaagtggttacgcagctgacaaagaaagcacacaaaaggccattggcgtgaccaataaagtaaactccatcattgataagatgaatacgcagttcgaggcggtggggcgcgaatttaacaacttagagcgaagaatagagaatctgaacaagaaaatggaagacggattcctcgatgtctggacttataatgccgagcttctggtgttgatggaaaacgagaggacactagacttccacgattctaatgttaagaacctgtacgacaaagtgcggctccagctgcgtgataatgcaaaggaacttggcaacggttgttttgagttctaccataaatgcgacaatgagtgtatggaaagcatccgcaacgggacctataatccacaatactcagaggaagctagactgaagagggaggagattagtggcgtcaagttggaatccatcggaacttatcagatcctcagcatttactctacagtggcctcaagtctggctttagccataatgatcgcaggcctgagcctatggatgtgctccaacgggtctctccagtgccggatttgtatc

SEQ ID NO: 28360 - RNA, 1698 nt, synthetic construct
  misc_feature 1..1698: note = derived and/or modified sequence opt3 from anti-influenza_Chain
  source 1..1698: mol_type = other RNA
atgaaggccatcctggtggtcctcctttacaccttcgctacagcaaacgccgacactctgtgcattggctatcacgcgaataacagcacggataccgttgacacagtgttggagaaaaatgtaactgtgacccattccgtcaacttactggaagataagcacaatgggaaactatgtaagctcagaggagtggctcccctgcatcttggtaaatgcaacatagccggctggatcctggggaatcctgagtgtgaatctttgtcaacagcaagtagctggtcctacattgttgagacctcttcgtcagacaacggaacttgctatccaggcgattttatcgactacgaggagctcagggagcagctgagcagtgtgtcctctttcgaacggtttgagattttcccgaagacaagctcctggcccaatcacgattcaaacaagggtgtcaccgccgcttgtcctcatgcaggggccaaaagtttttataagaatctgatctggctcgtgaaaaagggaaacagctacccaaaattatctaagtcctatataaatgacaagggcaaagaagtactggttctttggggcatccaccacccctcaacgagcgctgatcaacagagtttgtaccagaacgccgacgcgtacgtgttcgtcgggacttctcgctattccaagaaatttaagcctgagattgcaatccgaccaaaagtgcgtgatcaggagggaagaatgaattactattggaccctggtggaacccggtgacaagattacattcgaggccactggcaacctagtcgttcctaggtacgcttttgccatggaacggaacgcagggagcggaatcataatttcggataccccagtgcatgactgcaatacaacctgtcaaacgccgaaaggcgctatcaacacttctctccccttccagaatattcaccctatcacaatcggtaagtgcccaaagtatgtaaaatccaccaagctgcgccttgccactgggctgagaaacgtgccctcaattcagagtaggggattgtttggcgcgatagccggcttcatcgaagggggatggacaggtatggtcgacggctggtacgggtatcatcaccagaatgaacaaggaagcggctacgcagctgatctcaaatccacccagaacgccattgacgagatcacgaataaggtgaactctgttatagagaaaatgaatacccagtttacagctgtgggtaaggagttcaaccacctggaaaagcggattgaaaatttaaacaaaaaggtcgatgacgggttcctggatatctggacttacaatgccgagctccttgtgctgttggaaaacgagcgcaccctagactatcatgatagcaatgtaaagaacctgtacgagaaggttcgatcacagctcaaaaacaatgcaaaggaaatcggcaacggatgttttgagttctatcacaagtgcgacaatacatgtatggaaagtgtgaaaaacggcacttacgattatcctaagtactccgaggaagccaaactgaatagagaggagattgacggggtcaaacttgaaagcaccaggatctatcaaattctggctatatactctacagtggcgtcaagtttggtcctcgtggttagcctgggagcaatctccttttggatgtgctctaacggttcgttacagtgccggatttgtatc

SEQ ID NO: 28361 - RNA, 1698 nt, synthetic construct
  misc_feature 1..1698: note = derived and/or modified sequence opt3 from anti-influenza_Chain
  source 1..1698: mol_type = other RNA
atgaaggccatcctggtggtcctcctttacaccttcgctacagcaaacgccgacactctgtgcattggctatcacgcgaataacagcacggataccgttgacacagtgttggagaagaatgtaactgtgacccattccgtcaacttactggaagataagcacaatgggaaactatgtaagctcagaggagtggctcccctgcatcttggtaaatgcaacatagccggctggatcctggggaatcctgagtgtgaatctttgtcaacagcaagtagctggtcctacattgttgagacctcttcgtcagacaacggaacttgctatccaggcgattttatcgactacgaggagctcagggagcagctgagcagtgtgtcctctttcgaacggtttgagattttcccgaagacaagctcctggcccaatcacgattcaaacaagggtgtcaccgccgcttgtcctcatgcaggggccaaaagtttttataagaatctgatctggctcgtgaaaaagggaaacagctacccaaaattatctaagtcctatataaatgacaagggcaaagaagtactggttctttggggcatccaccatccccctacgtcagctgatcaacagagcttgtaccagaacgccgacgcgtacgtgttcgtcgggagttctcgctattccaagaaatttaagccagagattgcaatccgacccaaagtgcgtgatcaggagggaagaatgaattactattggactctggtggaacctggtgacaagattaccttcgaggccacaggcaacctagtcgttccaaggtacgcttttgccatggaacggaacgcagggagcggaatcataatttcggatactccggtgcacgactgcaataccacatgtcaaacccccaaaggcgctatcaacacgtctctccctttccagaatattcacccaatcactatcggtaagtgccccaagtatgtaaaatccacaaagctgcgccttgccaccgggctgagaaacattccttcaatacagagtaggggattgtttggcgcgatcgccggcttcattgaagggggatggactggtatggtggacggctggtacgggtatcatcaccagaatgaacaaggaagcggctacgcagctgatctcaaatccacacagaacgccatcgacgagataaccaataaggtcaactctgtgattgagaaaatgaatacgcagtttaccgctgttggtaaggagttcaaccacctggaaaagcggatcgaaaatttaaacaaaaaggtggatgacgggttcctggatatctggacatacaatgccgagctccttgtcctgttggaaaacgagcgcactctagactatcatgatagcaatgtgaaaaacctgtacgagaaggtacgatcacagctcaaaaacaatgcaaaggaaattggcaacggatgttttgagttctatcacaagtgcgacaatacctgtatggaaagtgttaaaaacggcacatacgattatccaaagtactccgaggaagccaaactgaatagagaggagatcgacggggtgaaacttgaaagcactaggatttatcaaatactggctatctactctaccgtcgcgtcaagtttggtgctcgtcgtgagcctgggagcaatttccttttggatgtgctctaacggttcgttacagtgccggatctgtatc

SEQ ID NO: 28362 - RNA, 1698 nt, synthetic construct; identical to SEQ ID NO: 28359
  misc_feature 1..1698: note = derived and/or modified sequence opt3 from anti-influenza_Chain
  source 1..1698: mol_type = other RNA

SEQ ID NO: 28363 - RNA, 1698 nt, synthetic construct; identical to SEQ ID NO: 28352
  misc_feature 1..1698: note = derived and/or modified sequence opt3 from anti-influenza_Chain
  source 1..1698: mol_type = other RNA

SEQ ID NO: 28364 - RNA, 1698 nt, synthetic construct; identical to SEQ ID NO: 28360
  misc_feature 1..1698: note = derived and/or modified sequence opt3 from anti-influenza_Chain
  source 1..1698: mol_type = other RNA

SEQ ID NO: 28365 - RNA, 1698 nt, synthetic construct; identical to SEQ ID NO: 28361
  misc_feature 1..1698: note = derived and/or modified sequence opt3 from anti-influenza_Chain
  source 1..1698: mol_type = other RNA

SEQ ID NO: 28366 - RNA, 1698 nt, synthetic construct; identical to SEQ ID NO: 28353
  misc_feature 1..1698: note = derived and/or modified sequence opt3 from anti-influenza_Chain
  source 1..1698: mol_type = other RNA

SEQ ID NO: 28367 - RNA, 1698 nt, synthetic construct; identical to SEQ ID NO: 28354
  misc_feature 1..1698: note = derived and/or modified sequence opt3 from anti-influenza_Chain
  source 1..1698: mol_type = other RNA

SEQ ID NO: 28368 - RNA, 1698 nt, synthetic construct; identical to SEQ ID NO: 28355
  misc_feature 1..1698: note = derived and/or modified sequence opt3 from anti-influenza_Chain
  source 1..1698: mol_type = other RNA

SEQ ID NO: 28369 - RNA, 1698 nt, synthetic construct; identical to SEQ ID NO: 28356
  misc_feature 1..1698: note = derived and/or modified sequence opt3 from anti-influenza_Chain
  source 1..1698: mol_type = other RNA

SEQ ID NO: 28370 - RNA, 1698 nt, synthetic construct; identical to SEQ ID NO: 28357
  misc_feature 1..1698: note = derived and/or modified sequence opt3 from anti-influenza_Chain
  source 1..1698: mol_type = other RNA

SEQ ID NO: 28371 - RNA, 1698 nt, synthetic construct; identical to SEQ ID NO: 28358
  misc_feature 1..1698: note = derived and/or modified sequence opt3 from anti-influenza_Chain
  source 1..1698: mol_type = other RNA

SEQ ID NO: 28372 - RNA, 1683 nt, synthetic construct
  misc_feature 1..1683: note = derived and/or modified sequence opt3 from anti-influenza_Chain
  source 1..1683: mol_type = other RNA
atggagaagatcgtgctcctgttcgccattgtcagccttgttaaatccgaccagatatgcatcggctaccacgctaacaattctaccgaacaagtggatacaattatggagaagaacgtaactgtgacgcatgcacaggacatcctggaaaagacccacaatgggaagttgtgtgatttagacggagtcaaacccctgattctaagagattgctcagtggccggttggctcctgggcaaccctatgtgtgacgagtttatcaatgttccagaatggagttatatagtggagaaggcgaacccggtcaatgatctttgctaccccggggacttcaacgattatgaggaactgaagcatttgctcagcaggatcaatcactttgagaaaattcagatcattcctaagtcctcttggtcgtcacatgaagctagcctgggagtgagttccgcctgtccataccagggcaaatctagcttctttcggaacgtagtttggctgatcaagaaaaattccacatatcccactataaagcgctcatacaacaataccaaccaagaggacctcttagtgctgtggggtattcaccaccctaatgatgcagccgagcagacaaaactttatcagaacccaaccacttacatcagtgtcgggacaagcaccttgaaccagcgactggtgccccgtattgctacgagatctaaagtgaatggacaatccggcaggatggagttcttttggactatcctaaagcctaacgacgcaatcaatttcgaatcaaacggcaattttattgccccagaatacgcttataaaatagtcaagaaaggggatagcaccatcatgaagagtgagctcgaatacggaaactgcaatacaaaatgtcagactccgatgggtgccattaactcttccatgcccttccataatatccaccctctgaccataggcgagtgcccaaagtatgttaagagcaaccggcttgtgctggcgacagggttgcgcaattcgccccagagagagaggcggcgcaaaaagcgaggactctttggcgcaattgccggtttcatcgaagggggatggcagggcatggtagacggctggtacgggtatcatcactctaacgagcaaggatccggttacgctgccgacaaagaatcaacccagaaggcaatcgatggcgtgacgaataaagtcaacagtattatcgacaagatgaatactcagtttgaggctgtggggagagagttcaacaacctggaaaggcggattgagaatttaaacaagaaaatggaagatggattcctggacgtttggacatataatgccgagctccttgtgctgatggaaaacgagcgtaccttggattttcacgacagcaatgtcaagaacctatacgataaagtgcgcctgcaactcagagacaatgcgaaggaactgggcaacggttgtttcgagttttaccataaatgcgataatgagtgtatggaatccgtaaggaacgggacttatgactaccctcagtattctgaggaagcccggcttaagcgagaggagataagcggcgttaagctggaatcaatcggaatttaccagatccagcacagtggcgggcgctccagcttggagggaccaagattcgaacaaaaactcatctctgaggaagatctgaatatgcatacaggt

SEQ ID NO: 28373 - RNA, 1683 nt, synthetic construct
  misc_feature 1..1683: note = derived and/or modified sequence opt3 from anti-influenza_Chain
  source 1..1683: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaaattatgtgatctggacggagtcaaacccctaattctcagagattgctcagtggccggttggctgcttggcaaccctatgtgtgacgagttcatcaatgttccagaatggagttatatagtggagaaggcgaacccggctaatgatctgtgctaccccgggaactttaatgactatgaggaattgaagcatctcctgagcaggatcaaccacttcgagaaaattcagatcattcctaagtcctcttggtcggatcatgaagcctcaagcggagtcagttccgcatgtccataccagggcaaatctagctttttccggaatgtggtatggctgatcaagaaaaactcctcatatcccacaataaagcgcagttacaataacactaatcaagaggacctcttagttctgtggggtattcaccaccctaacgatgccgctgagcagacccgactttatcagaacccaacaacctacatcagcgtggggacttctacattgaatcagcgtctggtccccaagattgcaaccagatccaaagtgaacggacaatcaggcaggatggaatttttctggacgatcctaaagcctaatgacgccatcaactttgagagcaatggcaacttcattgctccagaatacgcctataaaatagtgaagaaaggggatagtgcgatcatgaagtctgagctcgaatacggaaattgcaacactaaatgtcagaccccgatgggtgcaattaattccagcatgccctttcataacatccaccctctgacaataggcgagtgcccaaagtatgtcaagtcgaatcggcttgttctggccactgggttgcgcaactctccccagagagagaggcggcgcaaaaagcgaggactcttcggcgctattgccggttttatcgaagggggatggcagggcatggtggacggctggtacgggtatcatcactccaatgagcaaggatcaggttacgcagctgacaaagaaagtacccagaaggccatcgatggcgtaacaaacaaagtgaatagcattatcgacaagatgaacacccagttcgaggcggtcgggagagaatttaacaatctggagaggcggattgagaacttaaataagaaaatggaagatggattcctggacgtgtggacgtataacgccgagctccttgttctgatggaaaatgagcgtactttggatttccacgactccaacgtgaagaatctatacgataaagtccgcctgcaactcagagacaacgcaaaggaactgggcaatggttgttttgagttctaccataaatgcgataacgagtgtatggaatctgtgaggaatgggacatatgactaccctcagtatagcgaggaagctcggcttaagcgagaggagatatcaggcgtaaagctggaaagtatcggaatttaccagatccagcactccggcgggcgcagctctttggagggaccaagatttgaacaaaaactcatctcagaggaagatctgaacatgcataccggt

SEQ ID NO: 28374 - RNA, 1701 nt, synthetic construct
  misc_feature 1..1701: note = derived and/or modified sequence opt3 from anti-influenza_Chain
  source 1..1701: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggagaaaacccacaatgggaagttatgtgatctggacggagtcaaacccctaattctcagagattgctcagtggccggttggctgcttggcaaccctatgtgtgacgagttcatcaatgttccagaatggagttatatagtggagaaggcgaacccggctaatgatctgtgctaccccgggaactttaatgactatgaggaattgaagcatctcctgagcaggatcaaccacttcgagaaaattcagatcatttccaagtcttcgtggtcagatcatgaagccagcagtggagtctcctctgcatgtccttaccagggcacacccagctttttccggaatgtggtatggctgatcaaaaagaacaatacttatccaaccataaaacgctcctacaacaatacaaaccaagaggacctcttaattctgtggggtatccaccactcaaacaatgccgctgagcagaccaagctatatcagaaccctactacatacattagtgttgggaccagcacgttgaatctgcgacttgtgccaaagatcgcaactcgttctaaagtcaacggacagtccggcagaatggatttcttctggaccatcctcaagcccaatgacgccattaactttgaatcaaatggcaacttcatagctcctgagtacgcctataaaatcgtgaagaaaggggatagcgcgattatgaagagtgaagtggagtacggaaattgcaacacaaaatgtcaaactccaatcggtgcaataaattcttccatgccgtttcataacattcaccccctgaccatcggcgaatgccctaagtatgtcaagagcaataaacttgttctggccacagggttgaggaactcgccactccgggagcgcagaaggaagcggggactgttcggcgctatcgccggttttattgaagggggatggcagggcatggtggacggctggtacgggtatcatcactctaatgaacagggatccggttacgcagctgacaaagagtcaacccagaaggccatcgatggcgtaacgaacaaagtgaacagtattatagacaagatgaatactcaattcgaagcggtcgggcgcgagtttaacaatttagaacgaagaatcgagaacctgaataagaaaatggaggatggattcctcgacgtgtggacatataacgccgaacttctggttttgatggagaatgaaaggaccctagatttccacgacagcaacgtgaagaatctgtacgataaagtccggctccagctgcgtgacaacgcaaaggagcttggcaatggttgttttgaattttaccataaatgcgataacgagtgtatggagtccgtgcgcaatgggacttatgactacccccagtattctgaagaggctagactgaagagggaagagattagcggcgtaaagttggagtcaatcggaacataccaaatcctcagtatttattccaccgttgccagctctctggctttagccataatggtggcaggcctgtcactatggatgtgcagtaacgggagcctccagtgccggatctgtatt

SEQ ID NO: 28375 - RNA, 1701 nt, synthetic construct
  misc_feature 1..1701: note = derived and/or modified sequence opt3 from anti-influenza_Chain
  source 1..1701: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaagttatgtgatctggacggagtcaaacccctaattctcagagattgctcagtggccggttggctgcttggcaaccctatgtgtgacgagttcatcaatgttccagaatggagttatatagtggagaaggcgaacccggctaatgatctgtgctaccccgggaactttaatgactatgaggaattgaagcatctcctgagcaggatcaaccacttcgagaaaattcagatcattcctaagtcctcttggtcggatcatgaagcctcaagcggagtcagttccgcatgtccataccagggcacacccagctttttccggaatgtggtatggctgatcaaaaagaacaatacttatcctaccataaaacgcagctacaacaatacaaaccaagaggacctcttaattctgtggggtatccaccactccaacgatgccgctgagcagaccaaactttatcagaatccaactacatacatttcagttgggaccagtacgttgaaccagcgactggtgcccaagatcgcaactcgtagcaaagtcaatggacaatctggcagaatggactttttctggaccatcctaaagcctaacgatgccattaattttgaatccaacggcaatttcatagctccagagtacgcctataaaatcgtgaagaaaggggactcagcgattgtgaagtctgaagtcgagtacggaaactgcaatacaaaatgtcagactccgatcggtgcaataaacagttctatgccctttcataatattcaccctctcaccatcggcgaatgcccaaagtatgttaagtccaacaaactggtgcttgccacagggctgaggaatagccccttgcgggagcgcagaaggaagcggggactcttcggcgctatcgccggttttattgaagggggatggcagggcatggtagacggctggtacgggtatcatcactcgaacgaacagggatctggttacgcagctgataaagagtccacccaaaaggccatcgacggcgtgacgaataaagtcaactcaattatagataagatgaacactcagttcgaagcggtggggcgcgagtttaataacctggaacgaagaatcgagaatttaaacaagaaaatggaggacggattcctggatgtttggacatataatgccgaactccttgtgctgatggagaacgaaaggaccttggacttccacgatagtaatgtcaagaacctatacgacaaagtgcggctgcagctccgtgataatgcaaaggagctgggcaacggttgttttgagttctaccataaatgcgacaatgagtgtatggagagcgtacgcaacgggacttatgattaccctcaatattccgaagaggctagacttaagagggaagagatttctggcgttaagctggagagcatcggaacataccagatcttgtcaatttatagtaccgtggcctccagcctcgctctggccataatggtcgcaggcttatctctgtggatgtgctcaaatgggagtctacagtgccggatctgtatt

SEQ ID NO: 28376 - RNA, 1683 nt, synthetic construct
  misc_feature 1..1683: note = derived and/or modified sequence opt3 from anti-influenza_Chain
  source 1..1683: mol_type = other RNA
gacaagatctgcctgggccaccatgccgtgagcaacgggaccaaagtcaatacactcactgagagaggagttgaagtggtaaacgctacggagaccgtggaaaggacaaatgtcccccggatttgttccaagggtaaacgcactgtggatcttggccagtgcgggctgttgggaaccataacaggccctccacaatgtgaccagttcttagagttttctgcagatctgatcattgaacgacgtgagggttcagacgtttgctacccggggaagttcgtgaacgaggaagccctaagacagatcctcagggagagtggaggcattgataaagaaaccatgggctttacttatagcgggatccggacaaatggaaccacgtccgcgtgtcgcagatctggttcgtcattctacgctgagatgaagtggctgcttagcaacactgacaatgccgcatttccccagatgaccaagagttataaaaacacaaggaaggatcctgccctgataatctggggcattcaccattccgggtctactaccgagcaaacaaaattgtacggaagcggcaataagctcatcaccgtcggttcctcaaactatcagcagagtttcgtgccaagccccggggctcggcctcaggtaaatggacaatctggccgcattgactttcactggctgatcctgaacccaaatgatacggttactttctcctttaacggcgcattcatagcccccgaccgagcttcatttctcagagggaaaagcatgggtattcagagtgaagtgcaggtcgatgccaattgcgagggagactgttaccattctggcgggacaatcatttccaacttacctttccagaacatcaatagcagggcggtgggaaagtgcccacggtatgtgaagcaagaatcgctgcttttggcaaccggcatgaaaaacgtcccggagatccccaagcgtcgcagaaggggtctgtttggggccattgctggcttcatagaaaatggatgggagggcctaatcgatgggtggtacggattccggcaccagaacgcccagggtgagggcactgcagctgactacaaatctacacaatccgccattgaccagatcaccgggaagctcaatcgactgatagagaaaacgaaccagcagtttgaacttattgataatgagttcaccgaagttgaacgccaaatcggaaacgtgatcaattggacaagagactcaatgactgaggtatggagttataacgcggagctgttggtggccatggaaaatcagcacaccattgatctcgcagacagcgagatgaacaagctgtacgaaagggtcaaacggcagttacgcgagaatgctgaagaggatggcacaggttgttttgagatcttccataagtgcgacgatgactgtatggcctccattagaaacaatacttatgatcactctaagtacagggaagaggctatacagaaccgtatccaaattgaccctgtgaaactgagctcagggtataaggatagtggccggctcgttccacgaggatcccccggcagcgggtacatccctgaagccccaagagacggacaggcatatgtgaggaaagacggtgagtgggtccttctgtctacctttttgggcaagcccatcccgaaccctctactggggctcgattcaacagga

SEQ ID NO: 28377 - RNA, 1701 nt, synthetic construct
  misc_feature 1..1701: note = derived and/or modified sequence opt3 from anti-influenza_Chain
  source 1..1701: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaagttatgtgatctggacggagtcaaacccctaattctcagagattgctcagtggccggttggctgcttggcaaccctatgtgtgacgagttcatcaatgttccagaatggagttatatagtggagaaggcgaacccggctaatgatctgtgctaccccgggaactttaatgactatgaggaattgaagcatctcctgagcaggatcaaccacttcgagaaaattcagatcattcctaagtcctcttggtcggatcatgaagcctcaagcggagtcagttccgcatgtccataccagggcacacccagctttttccggaatgtggtatggctgatcaaaaagaacaatacttatcctaccataaaacgctcttacaacaatacaaaccaagaggacctcttaattctgtggggtatccaccactccaacgatgccgctgagcagaccaaactttatcagaatccaactacatacatttcagttgggaccagtacgttgaaccagcgactggtgcccaagatcgcaactcgtagcaaagtcaatggacaaaacggcagaatggactttttctggaccatcctaaagcctaatgatgccattaactttgaatctaatggcaacttcatagctccagagtacgcctataaaatcgtgaagaaaggggactccgcgattgtgaagtcagaagtcgagtacggaaattgcaacacaaaatgtcagactccgatcggtgcaataaatagcagtatgccctttcataacattcaccctctcaccatcggcgaatgcccaaagtatgttaagtctaataaactggtgcttgccacagggctgaggaactcccccttgcgggagcgcagaaggaagcggggactcttcggcgctatcgccggttttattgaagggggatggcagggcatggtagacggctggtacgggtatcatcacagcaatgaacagggatcgggttacgcagctgataaagagtctacccaaaaggccatcgacggcgtgacgaacaaagtcaactccattatagataagatgaatactcagttcgaagcggtggggcgcgagtttaacaatctggaacgaagaatcgagaacttaaataagaaaatggaggacggattcctggatgtttggacatataacgccgaactccttgtgctgatggagaatgaaaggaccttggacttccacgattcaaacgtcaagaatctatacgacaaagtgcggctgcagctccgtgataacgcaaaggagctgggcaatggttgttttgagttctaccataaatgcgacaacgagtgtatggagagtgtacgcaatgggacttatgattaccctcaatatagcgaagaggctagacttaagagggaagagatttccggcgttaagctggagtctatcggaacataccagatcttgagcatttattcaaccgtggccagttccctcgctctggccataatggtcgcaggcttaagcctgtggatgtgctctaacgggtcactacagtgccggatctgtatt

SEQ ID NO: 28378 - RNA, 1683 nt, synthetic construct; identical to SEQ ID NO: 28376
  misc_feature 1..1683: note = derived and/or modified sequence opt3 from anti-influenza_Chain
  source 1..1683: mol_type = other RNA

SEQ ID NO: 28379 - RNA, 1683 nt, synthetic construct; identical to SEQ ID NO: 28372
  misc_feature 1..1683: note = derived and/or modified sequence opt3 from anti-influenza_Chain
  source 1..1683: mol_type = other RNA

SEQ ID NO: 28380 - RNA, 1683 nt, synthetic construct; identical to SEQ ID NO: 28373
  misc_feature 1..1683: note = derived and/or modified sequence opt3 from anti-influenza_Chain
  source 1..1683: mol_type = other RNA

SEQ ID NO: 28381 - RNA, 1701 nt, synthetic construct; identical to SEQ ID NO: 28377
  misc_feature 1..1701: note = derived and/or modified sequence opt3 from anti-influenza_Chain
  source 1..1701: mol_type = other RNA

SEQ ID NO: 28382 - RNA, 1701 nt, synthetic construct; identical to SEQ ID NO: 28374
  misc_feature 1..1701: note = derived and/or modified sequence opt3 from anti-influenza_Chain
  source 1..1701: mol_type = other RNA

SEQ ID NO: 28383 - RNA, 1701 nt, synthetic construct; identical to SEQ ID NO: 28375
  misc_feature 1..1701: note = derived and/or modified sequence opt3 from anti-influenza_Chain
  source 1..1701: mol_type = other RNA

SEQ ID NO: 28384 - RNA, 1704 nt, synthetic construct
  misc_feature 1..1704: note = derived and/or modified sequence opt3 from anti-influenza_Chain
  source 1..1704: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaagttatgtgatctggacggagtcaaacccctaattctcagagattgctcagtggccggttggctgcttggcaaccctatgtgtgacgagttcctgaatgttccagaatggagttatatcgtggagaagataaacccggcgaatgatttgtgctaccccggggactttaacgattatgaggaactcaagcatctgctgagcaggatcaatcacttcgagaaaattcagatcattcctaagtcctcttggtcggactacgaggcttcaagcggagtcagttccgcctgtccatatcagggccggtctagctttttccgcaacgtggtatggctcatcaaaaagaataacgcataccccacaataaaacgatcctataataacactaatcaagaagatttactggttctttggggtattcatcaccctaacgacgccgctgagcagatccgtttgtaccagaacccaaccacatacatttcaatcgggaccagtactctgaatcagaggctagtgcccaagatcgcaacaagaagcaaggtcaacggacaatctggccggatggaatttttctggaccattctcaaatccaatgatgccataaactttgagtcaaatggcaacttcatcgctcctgaatatgcctacaagattgtgaaaaagggggacagcacgatcatgaaaagtgagctggaatatggaaattgcaacactaagtgtcagaccccaataggtgcgattaattcttccatgccgtttcacaacatccatccccttacaatcggcgagtgccctaaatacgtgaaaagcaatcgcctggtcttggcaactgggctcagaaactcgccacagggagagaggcggcgccgaaagagaggcctgttcggtgccattgctgggtttatcgaaggaggctggcagggcatggttgacgggtggtatggataccaccattctaatgagcaaggttccggctatgccgcagataaagaatcaacccagaaggctattgacggggtgacaaacaaagtaaatagtataatcaacaagatgaacacccagttcgaggccgtgggaagggaatttaataacttagagcggcgtattgagaatctgaacaaaaagatggaagatggcttcctcgacgtctggacgtacaatgcggagcttctggtgttgatggaaaacgagcgcactctagatttccacgacagcaatgttaagaacctgtacgataaagtgagactccaactgagggacaatgccaaggaacttggtaacgggtgttttgagttctatcaccggtgcgataatgagtgtatggaatccgtccgaaacggcacatacgactatccccagtactctgaggaagcacgcctgaaaagagaggagatcagcggagtgaagttggaatcaatgggcatctatcagattctcagtatatactccaccgtagctagctctctggccttagctatcatggttgccgggctgtttctatggatgtgctcaaatggaagtctccagtgcaggatttgtatc

SEQ ID NO: 28385 - RNA, 1704 nt, synthetic construct
  misc_feature 1..1704: note = derived and/or modified sequence opt3 from anti-influenza_Chain
  source 1..1704: mol_type = other RNA
atggagaagatcgtgctgctccttgccattgtcagcctggttaaatccgaccagatatgcatcggctaccacgctaacaattctaccgaacaagtggatacaattatggagaagaacgtaactgtgacgcatgcacaggacatcttggaaaagacccacaatgggaaattatgtgatctggacggagtcaaacccctaattctcagagattgctcagtggccggttggctgcttggcaaccctatgtgtgacgagttcatcaatgttccagaatggagttatatagtggagaaggcgaacccgacaaatgatctgtgctaccccgggagctttaacgactatgaggaattgaagcatctcctgtccaggatcaatcacttcgagaaaattcagatcattcctaagtcttcgtggtcagatcatgaagctagcagtggagtctcctctgcctgtccatacctgggcagcccctcctttttccggaacgtggtatggctcatcaaaaagaactcaacttatcctaccattaaaaagagttacaataatacaaaccaggaggacttactggttctttggggtatacaccacccaaatgatgcagccgagcaaacccgcttgtatcagaaccccactacatacatcagcattgggacctctacgctgaaccagcggctagtgcctaagatcgctactcgttccaaagtcaatggacagtcaggcagaatggaatttttctggaccatcctcaagccaaacgacgcaattaattttgagagcaacggcaatttcatagccccggaatacgcttataaaatcgtgaagaaaggggatagtgccattatgaagtctgagctggaatacggaaactgcaatacaaaatgtcaaactcccatgggtgcgatcaactccagcatgccttttcataatatacacccacttaccattggcgagtgccccaagtatgtgaagtcgaacaggctggtcttggcaacagggctccgaaattctcctcagcgcgagtccagaaggaaaaagcggggactgttcggcgccatcgctggttttatcgaagggggatggcagggcatggttgacggctggtacgggtatcatcactcaaacgagcagggaagtggttacgccgcagacaaagaaagcacccaaaaggctattgatggcgtgacgaataaagtaaactccatcattgacaagatgaatactcagttcgaggccgtggggcgcgaatttaacaacttagagcgaagaatagagaatctgaacaagaaaatggaagatggattcctcgacgtctggacatataatgcggagcttctggtgttgatggaaaacgagaggaccctagatttccacgactctaatgttaagaacctgtacgataaagtgcggctccagctgcgtgacaatgccaaggaacttggcaacggttgttttgagttctaccataaatgcgataatgagtgtatggaaagcatccgcaacgggacttataattacccacaatattcagaggaagcaagactgaagagggaggagattagtggcgtcaagttggaatccatcggaacataccagatcctcagcatttattctaccgtggcttcaagtctggccttagctataatgatggccggcctgagcctatggatgtgctccaacgggtctctccagtgccggatctgtatt

SEQ ID NO: 28386 - RNA, 1704 nt, synthetic construct
  misc_feature 1..1704: note = derived and/or modified sequence opt3 from anti-influenza_Chain
  source 1..1704: mol_type = other RNA
atggagaagatcgtgctcctgttcgccattgtcagccttgttaaatccgaccagatatgcatcggctaccacgctaacaattctaccgaacaagtggatacaattatggagaagaacgtaactgtgacgcatgcacaggacatcctggaaaagacccacaatgggaagttgtgtgatttagacggagtcaaacccctgattctaagagattgctcagtggccggttggctcctgggcaaccctatgtgtgacgagtttatcaatgttccagaatggagttatatagtggagaaggcgaacccggtcaatgatctttgctaccccggggacttcaacgattatgaggaactgaagcatttgctcagcaggatcaatcactttgagaaaattcagatcattcctaagtcctcttggtcgtcacatgaagctagcctgggagtgagttccgcctgtccataccagggcaaatctagcttctttcggaacgtagtttggctgatcaagaaaaattccacatatcccactataaagcgctcatacaacaataccaaccaagaggacctcttagtgctgtggggtattcaccaccctaatgatgcagccgagcagacaaaactttatcagaacccaaccacttacatcagtgtcgggacaagcaccttgaaccagcgactggtgccccgtattgctacgagatctaaagtgaatggacaatccggcaggatggagttcttttggactatcctaaagcctaacgacgcaatcaatttcgaatcaaacggcaattttattgccccagaatacgcttataaaatagtcaagaaaggggatagcaccatcatgaagagtgagctcgaatacggaaactgcaatacaaaatgtcagactccgatgggtgccattaactcttccatgcccttccataatatccaccctctgaccataggcgagtgcccaaagtatgttaagagcaaccggcttgtgctggcgacagggttgcgcaattcgccccagagagagaggcggcgcaaaaagcgaggactctttggcgcaattgccggtttcatcgaagggggatggcagggcatggtagacggctggtacgggtatcatcactctaacgagcaaggatccggttacgctgccgacaaagaatcaacccagaaggcaatcgatggcgtgacgaataaagtcaacagtattatcgacaagatgaatactcagtttgaggctgtggggagagagttcaacaacctggaaaggcggattgagaatttaaacaagaaaatggaagatggattcctggacgtttggacatataatgccgagctccttgtgctgatggaaaacgagcgtaccttggattttcacgacagcaatgtcaagaacctatacgataaagtgcgcctgcaactcagagacaatgcgaaggaactgggcaacggttgtttcgagttttaccataaatgcgataatgagtgtatggaatccgtaaggaacgggacttatgactaccctcagtattctgaggaagcccggcttaagcgagaggagataagcggcgttaagctggaatcaatcggaatttaccagatcttgagtatctattccacagtggcaagctctctcgctctggccattatggtcgctggcttatcactgtggatgtgcagtaatgggagcctacagtgccgcatatgtatc

SEQ ID NO: 28387 - RNA, 1704 nt, synthetic construct; identical to SEQ ID NO: 28384
  misc_feature 1..1704: note = derived and/or modified sequence opt3 from anti-influenza_Chain
  source 1..1704: mol_type = other RNA

SEQ ID NO: 28388 - RNA, 1704 nt, synthetic construct; identical to SEQ ID NO: 28385
  misc_feature 1..1704: note = derived and/or modified sequence opt3 from anti-influenza_Chain
  source 1..1704: mol_type = other RNA

SEQ ID NO: 28389 - RNA, 1704 nt, synthetic construct; identical to SEQ ID NO: 28386
  misc_feature 1..1704: note = derived and/or modified sequence opt3 from anti-influenza_Chain
  source 1..1704: mol_type = other RNA

SEQ ID NO: 28390 - RNA, 1707 nt, synthetic construct
  misc_feature 1..1707: note = derived and/or modified sequence opt3 from anti-influenza_Chain
  source 1..1707: mol_type = other RNA
agcaagtccagaggctacaaaatgaacacccagatcctggtgttcgccctcgtcgcttctattcccacaaatgcagacaagatatgccttgggcaccatgccgtttcaaacggaactaaagtgaatacgctgaccgagaggggtgtagaagtggtcaacgcgacagagactgtggaacggaccaatgttcctcgcatctgtagtaagggcaaacgaacagtggatttggggcaatgcggattactgggcaccattactggtccaccgcagtgtgaccagtttctagagttcagcgctgatctcatcattgaacgtagagaggggtccgacgtctgctatcccggaaagtttgtgaacgaggaagccctgaggcagatccttcgggagtctggcggcatagataaggaaacaatggggttcacctactcgggaatccgcacgaatggtactacctcagcatgtagaaggagcggcagttccttttatgccgagatgaaatggctgttgtctaacacagacaatgctgcattccctcaaatgactaagagctacaaaaacacccggaaggatccagccctcattatctgggggattcaccattccggatcaacaaccgagcagacgaaactgtatggcagtggtaataagctgatcactgtagggagctctaactaccagcagtcctttgttccctcacctggagctcgcccacaagtgaatggccagagcggccgaatagacttccactggctcattttaaaccccaatgatacagtcacctttagtttcaacggggcctttatcgcgcctgacagagcatctttcctgaggggaaagtccatgggtattcagagcgaagtacaggtggatgccaactgcgagggcgactgttatcattctgggggaactatcatctcgaatcttccatttcaaaacattaattcccgggctgtcggcaaatgcccgcgttacgttaagcaggaatcattgctgctagccacaggtatgaaaaacgtgcccgagatacctaagcgcagaaggcggggcctcttcggggcaatcgctggattcattgaaaatggctgggaggggctgatcgatggatggtacggttttcgacaccagaacgcccaaggcgaggggaccgcggccgactataaaagtacgcagagcgcaatagaccagattaccggaaaacttaatcgcctgatcgaaaagacaaaccagcaattcgagttgatcgataatgaatttactgaggtagaaagacagattggcaacgtgatcaattggaccagggactccatgacagaggtctggtcttacaacgctgagctcctggtggccatggaaaatcagcacactattgatttagctgacagcgagatgaacaagctgtatgaacgggttaagcgccagctcagagagaatgccgaagaggatggtaccgggtgtttcgagatatttcataaatgcgacgatgactgtatggcatcaatcaggaacaacacatacgatcacagtaagtatcgtgaagaggccattcaaaatcggatccagatcgacccagtgaaactttccagcggctacaaggatgtcattctgtggttctcttttggagcttcatgcttcatattgctagcgatcgcaatgggcctggtgtttatttgcgtgaaaaacgggaatatgcgatgtaccatctgcatt

SEQ ID NO: 28391 - RNA, 1707 nt, synthetic construct; identical to SEQ ID NO: 28390
  misc_feature 1..1707: note = derived and/or modified sequence opt3 from anti-influenza_Chain
  source 1..1707: mol_type = other RNA

SEQ ID NO: 28392 - RNA, 1692 nt, synthetic construct
  misc_feature 1..1692: note = derived and/or modified sequence opt3 from anti-influenza_Chain
  source 1..1692: mol_type = other RNA
gaccagatctgcattggctaccacgccaacaatagcaccgagaaggtggatacaaacctggaaagaaatgtcactgttacgcatgctaaagacatactcgagaagacccacaacgggaaactttgtaagctgaatggaatccctcccttggaattaggtgattgctccattgcaggctggctgctagggaacccagagtgtgacaggctcctgtctgtgccggaatggtcatatatcatggagaaagagaatccccgggatggactttgctaccctggcagtttcaacgactatgaagaactgaagcatttgctcagctccgtaaagcactttgaaaaagtgaagattctgccaaaagatcgctggacacaacatactaccacaggtgggtctcgagcctgtgcggtctcgggaaatccctcattctttcgtaacatggtgtggctgaccaaggagggcagcgactaccctgttgctaaaggcagttataataacacttccggggagcagatgctcatcatatggggagtgcaccacccaatcgatgaaacagagcagagaaccttataccagaatgtcggtacgtatgtgtctgtaggcactagcaccctgaacaagaggtccacacccgaaattgccactcggcctaaggttaatgggcaaggaggccgcatggagttctcatggacccttttggacatgtgggatacaatcaactttgaaagtaccggtaacctgattgcaccagagtacgggttcaaaatcagcaagagaggatcttccggcataatgaaaacggagggcactctagaaaattgcgagacaaagtgtcagaccccgctcggggccattaacactacactgccctttcataatgtgcaccctcttaccatcggagaatgcccaaaatacgtcaagtcagagaaactggtgttggctacgggtctcaggaacgtgccccagattgaaagccggggcctgttcggggcaatcgccggatttatcgagggcggttggcaggggatggtcgacggctggtatggataccatcacagtaatgatcaaggctctgggtatgctgccgacaaggagtccacccagaaggcgttcgacggaattacaaacaaagttaatagcgtgatagaaaagatgaacactcagtttgaggcagtaggtaaagagttcggcaatttagagcgccgactggaaaacctcaataagagaatggaggatgggtttcttgacgtgtggacctacaacgccgagctgttggtcctaatggaaaatgagaggacactggatttccacgactcgaacgtgaaaaatctctatgataaggttcggatgcagctgcgtgacaacgtgaaggaacttggaaacggctgtttcgagttttaccataaatgcgatgacgagtgtatgaactctgtcaagaatggtacttatgattaccctaaatacgaagaggaatccaagctgaatcgcaacgagatcaaaggggtgaagttgtcaagtatgggcgtatatcaaagcggaagactcgttccaaggggctcccccgggtctggatacattccggaagctcctcgggacggtcaggcctatgtgcgaaaggatggcgagtgggtcctgttaagcaccttcctggggaaacccatcccaaatcctctactcggactggactcaacaggc

SEQ ID NO: 28393 - RNA, 1692 nt, synthetic construct
  misc_feature 1..1692: note = derived and/or modified sequence opt3 from anti-influenza_Chain
  source 1..1692: mol_type = other RNA
cagaagctgcccggcaacgacaatagcaccgccacactctgccttgggcaccatgctgtgcctaacggaactatcgtcaaaacgattaccaatgatcaaatagaggttacaaacgcaactgaactggtgcagtcctcttcaaccggtggcatctgtgacagtccacaccagattttggatggggagaattgcacattaatcgacgccctgctaggagatccgcagtgtgacggcttccaaaacaagaaatgggatctctttgtagaaagaagcaaggcgtactccaattgctatccctacgacgtgcctgattatgcttctctgaggtcgcttgtcgcctcaagcggtaccctggagttcaacgacgaaagttttaattggactggggtgacacagaacggaacctcctctagctgtaaacggcgctccaataactcattctttagtcgattgaattggctcacgcagctgaagttcaagtacccagcactgaacgttactatgcccaataacgagaaatttgataagctctatatttggggcgtgcatcaccctgtcaccgacaacgatcagatcttcttatacgcccaagctagcggccgtataacagtgtctactaaaagatcccagcagaccgtaatcccaaatattgggtcaaggccccggatccgcaacattcctagcagaatcagtatatattggacaattgttaagccaggagacatcctgcttattaattctaccggtaacttgatcgcaccgaggggctactttaaaatccggtccggaaagagctcgattatgcgctctgacgcccccatagggaagtgcaattccgagtgtatcacgcctaacggctcaattccaaatgataaacccttccagaacgtgaatcgaatcacttacggtgcttgccctagatatgtcaagcaaaacacactgaaactagccaccgggatgaggaatgtgccagaaaagcagactcggggaatatttggcgcgattgcaggcttcatcgagaacgggtgggaaggaatggtggacggttggtacggctttcgtcatcagaatagtgaggggatcggacaagccgctgatctcaaaagcacacaggccgcaattaaccagatcaatggcaagctgaaccgccttattggtaaaaccaacgagaagttccaccagatagaaaaggagttctccgaagtcgaggggagaatccaagacctggaaaaatatgttgaggatacgaagattgacttgtggtcttacaatgctgagctcctggtggccttagaaaaccagcacaccatcgatctgacagacagcgagatgaataaactctttgaaaggactaagaaacagcttcgggagaacgcggaagatatgggcaatggatgtttcaagatctatcataagtgcgacaacgcctgtattggctcaatacgaaatgggacctacgatcacgacgtatatcgcgacgaggcactgaacaatagatttcagatcaaaggagtggagttgaagagtggttccggcaggctagtcccccgggggagcccgggatctggctacattcctgaagctccccgcgatggtcaagcctacgtgagaaaagacggggagtgggttctgctctcaacattcctgggcaagccaatccctaacccccttctgggattggatagtactggc

SEQ ID NO: 28394 - RNA, 1692 nt, synthetic construct; identical to SEQ ID NO: 28392
  misc_feature 1..1692: note = derived and/or modified sequence opt3 from anti-influenza_Chain
  source 1..1692: mol_type = other RNA

SEQ ID NO: 28395 - RNA, 1692 nt, synthetic construct; identical to SEQ ID NO: 28393
  misc_feature 1..1692: note = derived and/or modified sequence opt3 from anti-influenza_Chain
  source 1..1692: mol_type = other RNA

SEQ ID NO: 28396 - RNA, 1695 nt, synthetic construct
  misc_feature 1..1695: note = derived and/or modified sequence opt3 from anti-influenza_Chain
  source 1..1695: mol_type = other RNA
gacaccatctgcattggctaccacgccaacaatagcacagatactgtggacacggtcctggagaagaacgttaccgtgacacattccgtaaatctccttgaagattctcacaacgggaaactgtgtttgttaaagggaatagctcccctgcagctaggtaattgctcagtggcaggctggatcctcgggaaccctgagtgtgaactgcttattagtagagagagctggtcctatatcgtcgaaaaaccaaatccggagaacggaacttgctaccccggccatttcgccgactatgaggaactgagggagcaattgtcttcggtgagctcatttgaacggttcgagatttttcctaaggagagttcctggccaaatcacaccacaaccggtgtttctgcgagctgttcccataacggggaatcaagtttctacaaaaatctcctgtggctgactggaaagaacggcctctatcccaatttaagcaagtcttacgctaacaataaagagaaggaagtgctggtcctttggggcgtgcaccaccctccaaacatcggggatcagcgcgccttgtatcataaagagaacgcatacgtatccgttgtgtcaagccactacagtcgaaagtttacacccgaaatagccaaacgtcctaaggtcagagaccaggagggaaggatcaattattactggaccctgctagagccaggtgatacgattatcttcgaagctaacggcaatctcattgcaccgcggtatgcctttgctctgtctcgcgggttcggatccggcatcataaacagcaatgcccccatggacgagtgcgatgcgaagtgtcagactcctcaaggtgcaattaactcgtctcttccatttcagaatgtgcatcccgtgaccatcggggaatgccctaaatacgtcagatccgccaagctgaggatggttacaggattgcggaacattccatcaatccagagtcgcggcctcttcggcgctatcgccgggtttattgagggaggttggactggcatggtggacgggtggtatggataccaccaccagaatgaacaaggcagcggttatgcagctgatcagaaatccacccagaacgccataaatgggatcacaaacaaggtaaattctgtgattgagaaaatgaacacccagttcacggcggtcggcaaggagtttaataaactggaacgaagaatggagaacttaaacaagaaggtggacgatggattcatcgacatatggacttacaatgccgaactgctcgttcttctggagaacgaaaggacattggacttccatgatagcaatgtgaaaaacctatacgagaaggtcaaatcacaactgaagaataacgcaaaagagattggcaatgggtgttttgagttctatcacaagtgcaacgacgaatgtatggaaagtgtgaagaatggaacctacgattatcccaaatactccgaggagagcaagctcaaccgggagaaaatcgacggtgtaaagctggaatctatgggcgtttatcagtcagggcgtcttgtgccgcgcggaagtcctggcagcggttacatccccgaagctccaagagatgggcaggcctatgtcaggaaagacggcgagtgggtgctgttgtccacttttctcggaaagcctattcccaatccactgttaggcctggattctacaggg

SEQ ID NO: 28397 - RNA, 1695 nt, synthetic construct
  misc_feature 1..1695: note = derived and/or modified sequence opt3 from anti-influenza_Chain
  source 1..1695: mol_type = other RNA
caaaactacaccggcaatcccgtgatctgcctggggcaccatgccgtcagcaacggaacaatggttaagactctcacggacgatcaaattgaggtggtaaccgctcaggaacttgtggagtcccagcatctgcctgaattgtgtccatctccgttaagactggtcgacggtcagacatgcgatatagtgaatggcgcactagggtcacccggatgtgaccacctcaacggcgccgagtgggatgttttcatcgaaaggcctactgcggtggatacctgctatccatttgatgtccccgactaccaaagtctgcggagcattcttgctaataacggtaaattcgagtttatcgccgaggagttccagtggaatacagtgaagcagaacgggaaatccggagcatgtaagcgcgccaatgtaaacgactttttcaatcgactgaactggttgaccaaatctgacggcaatgcttatcctctccagaacctgactaaggttaataacggcgattacgcacgtctgtatatttggggagtgcaccatccatcgacagacaccgaacaaacgaacctctacaagaataaccccgggagagtcactgtgtcaacccagacaagccagactagcgtggtccctaatatcggttccaggccatgggttcggggcttatctagccgcatatccttttattggaccatcgtggaaccgggggatctgattgtattcaacacaatcggaaatcttattgcccccagaggccactacaaattgaactcacagaagaaaagtaccatcctgaatacggctgtgcctataggtagctgcgtctctaagtgtcacactgacaaagggtccatttcaacaaccaagccatttcaaaacatcagcaggattagtatcggagactgccccaagtacgtgaaacagggctctctaaagctcgccactggcatgcggtccatcctggagaaagcgacacgcgggcttttcggagcaattgccggttttatagagaatggctggcaggggctgatcgatggatggtatggcttccgacatcaaaacgctgaaggtaccgggacggccgcagacttgaagagtacccaggctgccattgatcagatcaatggcaaactcaacagactgataggaaagcctaatgagaaataccaccagattgaaaaggagtttgaacaagttgagggcaggatccaggacttagagaagtatgtggaagatacaaaaatcgacctgtggtcgtacaacgcggagctccttgtcgccctggaaaatcagcatactattgatgtgaccgactctgagatgaacaagttgttcgaacgggtacgtcaccagctacgcgagaacgcagaggataaagggaatggatgtttcgaaatctttcaccaatgcgacaactcctgtattgagtcaataagaaatggtacatatgatcatgacatctacagggacgaagctattaacaatcggttccagatccagggcgttaagctgatccaggggtataaagatagtggacgactcgtgccacgcggcagccccggttccgggtacattccggaggcccctagagacggccaggcttacgtcaggaaggatggagaatgggtgctgctttctacttttctgggcaagcccataccaaaccctttgctcgggctggacagcaccgga

SEQ ID NO: 28398 - RNA, 1695 nt, synthetic construct
  misc_feature 1..1695: note = derived and/or modified sequence opt3 from anti-influenza_Chain
  source 1..1695: mol_type = other RNA
gaccagatctgcattggctaccacgccaacaatagcaccgagcaagtggatacaataatggaaaagaacgtcactgttacgcatgctcaggacatcctggagaaaacccacaatgggaagctctgtaaccttgatggagtgaaacccctgattttgaaggactgctccgtagcaggttggttactgggcaatcctatgtgtgatgagttcctaaacgtgtctgaatggtcatatatcgtcgaaaaagccagtccagcgaatgggctctgctacccgggagactttaacgattatgaggagctgaagcatcttctgagcagaattaatcacttgaagaaaatcaagataatccccaaatcctactggtctaaccatgaggcttcgtcaggcgtgagcgccgcatgtagttatctcggtgaaccttccttctttaggaatgttgtgtggctgattaagaaaaacaatacatacccacccatcaaggtcaactatactaataccaaccaggaagacctgctcgtgttatgggggattcaccaccctaacgatgagaaggagcagatccggatataccaaaatccaaacacatctattagcgtaggaacctccactctgaatcagcgccttgttcccaaaatcgccacacgacctaaggtgaacggccagtcaggccgtatggagttcttttggaccattttgaaaccaaatgacagtatcaacttcgatagcaatgggaactttatcgctccggaatacgcatataagattgccaaaaagggagactctgtcataatgaaatccgaactggagtacggtaattgcaacacgaagtgtcagactcccatgggcgctatcaattcaagcatgcctttccataacattcacccactaaccatcggggaatgccccaagtatgtgaaaagtaatagactcgtgctggccacaggacttaggaacgcgcctcaaactgagacccggggcctgtttggtgcaatagccgggttcattgagggaggctggcagggcatggtcgatgggtggtacggatatcatcactctaatgaacagggttccggctacgctgccgacaaggagagcacacagaaagcaatcgacgggatcaccaacaaggttaactcgattatcgataaaatgaatacgcaatttgaaattgtgggacgcgagttcaacaatttggaaagaaggatagagaacctcaataagaagatggaggacggctttctggatgtatggacttataacgctgaattactggtgctcatggagaatgaacggacacttgacttccacgattctaacgtcaaaaatctgtacgagaaggtgcgcttgcagctacgagacaacgccaaagaactgggtaatgggtgtttcgagttttaccataagtgcgataacgagtgtatggaatccgttagaaatggcacctatgactacccacagtattcagaggaagcgaggctcagtcgggaggagatcagcggagtgaaaatggaatccatggtcacttaccaatctggccgtctggtgccccgcgggagcccgggatcaggttatattcctgaggcccccagagatggccaggcatacgtaaggaaggacggggaatgggttcttctgagtacattcttgggaaagccaatccctaaccccctcctgggcttagattccaccggt

SEQ ID NO: 28399 - RNA, 1695 nt, synthetic construct; identical to SEQ ID NO: 28396
  misc_feature 1..1695: note = derived and/or modified sequence opt3 from anti-influenza_Chain
  source 1..1695: mol_type = other RNA

SEQ ID NO: 28400 - RNA, 1695 nt, synthetic construct; identical to SEQ ID NO: 28397
  misc_feature 1..1695: note = derived and/or modified sequence opt3 from anti-influenza_Chain
  source 1..1695: mol_type = other RNA

SEQ ID NO: 28401 - RNA, 1695 nt, synthetic construct; identical to SEQ ID NO: 28398
  misc_feature 1..1695: note = derived and/or modified sequence opt3 from anti-influenza_Chain
  source 1..1695: mol_type = other RNA

SEQ ID NO: 28402 - RNA, 1698 nt, synthetic construct
  misc_feature 1..1698: note = derived and/or modified sequence opt3 from anti-influenza_Chain
  source 1..1698: mol_type = other RNA
gacaccctgtgcatcggctaccacgccaacaatagcacagatactgtggacacggtcctcgagaagaacgttaccgtgacacattccgtaaatcttctggaagataaacacaacgggaagttgtgtaaattaagaggagtggctcccctgcatctaggtaagtgcaatattgcaggctggatactcgggaaccctgagtgtgaatctctgtcaactgccagtagctggtcctatatcgtcgagaccccatcttcggacaatggaacatgctacccgggcgatttcattgactatgaggagcttagggagcagctgtcaagcgtgagttcctttgaacggttcgagatctttcccaaaacctctagctggcctaaccacgattccaataagggtgttactgcggcttgtccacatgccggggcaaagtcattctacaaaaacttgatttggctcgtgaagaaaggaaatagttatcccaagctgagcaaatcttacatcaacgacaagggcaaggaagtcctggtgctctggggcatacaccacccttccacatcagccgatcaacagagcttatatcagaatgctgacacctacgtatttgttgggagttctcgctactccaaaaagttcaaaccagagatcgcaattcgacccaaggtgcgtgatcaggagggaagaatgaactattactggacgctggtcgaacctggtgacaaaatcacttttgaggccaccggcaatcttgtggtgccaaggtatgctttcgccatggaacggaacgcggggagcggaattatcatatcggatacaccggtccatgactgcaacactacctgtcaaacacccaagggcgcaattaatacctctttgccttttcagaacatccacccaattacgatcggtaaatgccccaagtacgttaagtccactaaactgcgcctagccacagggctcagaaatatcccttcaattcagagtaggggactgttcggcgctatagccggctttatcgaagggggatggaccggtatggtggacggctggtatgggtaccatcaccagaacgaacaaggaagcggctatgcagctgatcttaagtccactcagaatgccattgacgagatcacaaacaaagtaaattctgtgatagagaagatgaacacccagttcacggcggtcggtaaagaatttaatcacctggagaagcggattgaaaacttgaataagaaagtggatgacgggttcctcgatatctggacctacaacgccgagctgttagttctgctcgaaaatgagcgcacacttgactaccatgatagcaacgtgaagaatctgtatgagaaagtccgatcacagttgaagaacaacgcaaaagaaatcggcaatggatgtttcgagttttaccacaagtgcgacaacacttgtatggaaagtgtgaagaatggcacctatgattacccaaaatattccgaggaagctaagctaaacagagaggagattgacggggtaaaactggaaagcacaaggatctaccaatctggacggctcgttccccgtggttcaccgggcagtgggtatattcctgaggctccccgcgatggacaggcctacgtgagaaaggacggcgaatgggtcctgcttagcactttcctgggtaaaccaatacctaatcccttgctcgggctggactccaccggc

SEQ ID NO: 28403 - RNA, 1698 nt, synthetic construct
  misc_feature 1..1698: note = derived and/or modified sequence opt3 from anti-influenza_Chain
  source 1..1698: mol_type = other RNA
gacagaatctgcattggctaccaaagcaacaattccaccgatacagtgaacactctgatagagcaaaaggtccccgttacgcagaccatggaactcgtggagacagaaaaacaccctgcctattgtaatactgaccttggggctccactggagttgagggattgcaagatcgaagcagtaatttacggaaacccgaaatgtgacatccatttaaaggatcagggttggtcttatattgtggagcggccctcagcccctgagggcatgtgctacccagggagtgtcgaaaatctggaggaactacgcttcgtgtttagctccgcggcttcttataaacgaatccgtctcttcgactactcgagatggaacgttacctcaagcggaacaagtaaggcctgtaatgcatccaccggcggtcagtctttttataggagcataaactggctgactaagaaaaagcccgatacatacgacttcaatgaggggacctacgtgaacaatgaggatggagacatcatttttctttggggcatccaccatcctccagatacgaaagaacaaactaccctgtataagaacgccaatacattgtcctcagtcactaccaacacaattaatcggagtttccagcccaacatcggccctcgcccactcgtgagagggcagcagggaaggatggactactattggggtatactgaaacggggcgagaccctgaagattcgcacgaacgggaatctcatcgctccggaatttggatacttactgaagggcgagagccacggtcgaactattcaaaacgaagatatccccatcgggaattgctatacaaaatgtcagacctacgcaggagccattaactcttccaagcctttccagaatgcttcaagacattatatgggcgagtgcccaaaatacgtaaagaaagccagccttaggttggcggttggcctgcggaacactcccagtgtggagcctcgtgggctatttggagcaatagccggtttcatcgaaggcgggtggtctggaatgattgacggctggtacggttttcaccactccaatagcgaggggacaggcatggctgccgaccagaagtcgacccaagaagcaatcgataaaataacgaacaaggtcaataacattgtggacaagatgaatcgcgagttcgaagtggtcaaccatgagttttctgaggttgaaaagagaatcaatatgatcaacgataagattgacgatcagatcgaggacctctgggcttataatgccgaactgcttgtgctgttggagaaccagaaaaccctcgatgaacacgactccaacgtaaagaatctgttcgatgaggtgaaaaggcggttatcagcgaacgccattgacgcaggaaatggctgtttcgatatactgcataagtgcgacaacgagtgtatggaaacaatcaagaatgggacttacgaccacaaagagtatgaagaggaggctaagctcgaacgaagtaaaattaacggagtcaaacttgaggaaaataccacatacaaaagcggtcgcctggtgccaagaggctcccccgggtctggatatatcccggaggcccctagggatggccaggcttacgttcggaaggacggtgaatgggtgttgctaagcacttttctggggaagcccatcccaaaccctctcctgggccttgattcaaccgga

SEQ ID NO: 28404 - RNA, 1698 nt, synthetic construct; identical to SEQ ID NO: 28402
  misc_feature 1..1698: note = derived and/or modified sequence opt3 from anti-influenza_Chain
  source 1..1698: mol_type = other RNA

SEQ ID NO: 28405 - RNA, 1698 nt, synthetic construct; identical to SEQ ID NO: 28403
  misc_feature 1..1698: note = derived and/or modified sequence opt3 from anti-influenza_Chain
  source 1..1698: mol_type = other RNA

SEQ ID NO: 28406 - RNA, 1701 nt, synthetic construct
  misc_feature 1..1701: note = derived and/or modified sequence opt3 from anti-influenza_Chain
  source 1..1701: mol_type = other RNA
gacaagatctgcattggctaccacgccaacaatagcaccacacaggtggatactatactggagaaaaacgtcacggttacccattccgtggaactccttgagaatcaaaaggaagagagattctgtaaaatcctgaacaaggctcccttggacttaagggggtgcacaattgaaggatggatcctgggtaatcctcagtgtgatctactcctgggcgaccagtcttggtcatatattgtagagcggccaactgcacagaacgggatctgctacccgggagcccttaatgaggtggaggaactgaaagcgttgataggcagtggtgaacgcgtcgagcgatttgagatgttccccaagagcacctggacaggggtggatacctcctctggagttactaaggcttgtccttataactcgggcagctcattttaccgtaatctcctgtggatcattaaaacaaagagtgccgcatatccagtgatcaaaggcacctacaacaatacggggtcccaacccattctgtatttctggggagtccaccatcctccagacactaacgaacagaataccctctacggttctggcgatagatacgtgaggatggggacagagagcatgaactttgccaagtcccccgaaatcgctgcacggcctgccgtaaatggacagcgcggcagaatagactattactggtcagttttaaaaccaggtgagactctgaacgtggaaagtaacgggaatcttattgctccgtggtatgcctacaagttcgtcagcaccaacaataagggagcgatctttaaatctaacttgcccattgagaattgcgatgcaacatgtcagaccatcgccggcgtgctgaggacgaacaagactttccaaaatgtgtcccctctatggatcggcgagtgcccaaaatatgtcaagtcagaaagcctccggctggctacagggcttcgcaacgttccccagattgagacccgaggactgtttggtgccatagcaggcttcatcgaagggggatggactggcatgattgacggttggtacgggtatcaccatgagaatagtcagggctctggatacgctgccgataaagaatccacacagaaggcgatcgacggcataaccaacaaagtgaatagcattatcgataagatgaacacgcaatttgaggccgtagaccacgagttctcgaatttggaaagaaggatcgacaacctcaataagcggatggaggatgggtttctggacgtgtggacctacaacgcagaattactggtcctccttgagaacgaacgtacactggatttgcacgacgctaatgtgaaaaacctatatgagaaggttaaatctcagctgcgcgataatgccaacgacctcggaaatggttgtttcgagttctggcataagtgcgataacgaatgtattgagtccgtgaaaaatggcacttacgactatcctaagtaccaggatgaatcaaagctgaacagacaagagatcgagagtgtcaaacttgacaatctgggggtgtatcagagcggaaggttggtaccacggggctcccccggttctgggtacattccggaagctcctcgagatggccaggcctatgttcgcaaggacggagagtgggtgctcctgagcacctttttaggcaaacccataccaaaccctctgctagggctcgactcaacagga

SEQ ID NO: 28407 - RNA, 1701 nt, synthetic construct; identical to SEQ ID NO: 28406
  misc_feature 1..1701: note = derived and/or modified sequence opt3 from anti-influenza_Chain
  source 1..1701: mol_type = other RNA

SEQ ID NO: 28408 - RNA, 1704 nt, synthetic construct
  misc_feature 1..1704: note = derived and/or modified sequence opt3 from anti-influenza_Chain
  source 1..1704: mol_type = other RNA
gaccacatctgcattggctaccatgccaacaatagcaccgaacaggtggatacaataatggaaaagaacgtcactgttacgcacgctcaagacatcctggagaaaacccataatgggaagctctgtgatcttaacggagtgaaacccctgattttgaaggactgctccgtagcaggttggttactgggcaatcctatgtgtgatgagttcatcaacgtgccagagtggtcttatattgtcgaaaaagccaatccggcgaacgacctatgctaccccgggaattttaacgattatgaggagctcaagcatctgctttcaagaatcaatcacttcgaaaagatacagatcattcctaaagacagttggagcgatcacgaggcttccctgggagtgtcttcggcctgtccataccagggcaacagctcatttttcaggaatgttgtgtggttgatcaagaaaggtaacgcatatcccacaattaagaaaagttacaataacactaaccaggaagacctcctggtcctgtgggggatccaccatcctaatgatgaggccgagcaaacccggctctatcagaacccaacaacctacatatccattggaacttctacattaaatcagcgcctggtgcccaagatcgctacccgaagcaaggtaaacggccagtccggccgtattgactttttctggacgatccttaaacctaatgatgcaatcaactttgaatcaaatgggaacttcattgccccagagtacgcttataagatagttaaaaagggagacagtactatcatgaaaagcgaagtggagtacggtaattgcaacaccagatgtcaaacaccgatgggcgccattaattcttccatgccctttcacaacatccatcctttgactataggggaatgcccaaagtatgtcaaatcaaataagctggtgctagcgaccggactcaggaacagcccccagcgggagcgcagaaggaagcggggcctgttcggtgcaattgccgggtttatcgagggaggctggcagggcatggtggacgggtggtacggatatcaccacagtaatgaacagggttctggctacgctgccgataaagagtccacacaaaaggcaatcgacggggtcaccaacaaagttaacagcattatcgataagatgaatacgcagttcgaagctgtgggacgcgagtttaacaatcttgaacgaagaattgagaacctgaataaaaagatggaggacggcttcttggatgtatggacttataacgccgaactcctggtgttaatggagaatgaaaggacactggacttccatgattcgaacgtcaagaatctctacgacaaagtgcggcttcagctgcgtgataacgcgaaggagttgggtaatgggtgttttgagttctaccacaaatgcgacaacgaatgtatggagtctgttcgcaatggcacctatgattaccctcaatattccgaagaggccagactaaagagggaagagatatcaggagtgaaactggagagtatcggcacttaccagagcgggcggctcgtcccacgaggatcccccggttctggctatattccggaagcacctcgcgacgggcaggcttacgtgagaaaggacggagagtgggtactgcttagcacatttctgggcaagcccatcccaaaccctttgctcggtctggattcaaccggg

SEQ ID NO: 28409 - RNA, 1704 nt, synthetic construct
  misc_feature 1..1704: note = derived and/or modified sequence opt3 from anti-influenza_Chain
  source 1..1704: mol_type = other RNA
gaccagatctgcattggctaccacgccaacaatagcaccgagcaagtggatacaataatggaaaagaacgtcactgttacgcatgctcaggacatcctggagaaaacccacaatgggaagctctgtgatcttgacggagtgaaacccctgattttgagagattgctccgtagcaggttggttactgggcaaccctatgtgtgacgagttcatcaatgtgccagagtggtcttatattgtcgaaaaggccaacccggcgaatgatctatgctaccccgggaactttaatgactatgaggagctcaaacatctgctttcaaggatcaaccacttcgaaaagatacagatcattcctaagagtagctggtccgatcatgaggcttcttcgggagtgtcaagcgcctgtccataccagggcacaccctcctttttccggaatgttgtgtggctgatcaaaaagaacaatacttatcctaccattaaacgcagttacaacaatacaaaccaagaagacttgctcatcctgtggggtatacaccactctaacgatgcagccgagcagaccaagctgtatcagaatccaactacatacattagcgtcgggacctccacgctcaaccagcgattagtgcccaaaatcgctactcgttcaaaggtaaatggacaaagtggcagaatggactttttctggaccattctgaagcctaacgatgcaatcaattttgagagcaacggcaatttcatcgccccagaatacgcttataaaattgttaagaaaggggactctgccatagtgaagtccgaggtcgaatacggaaactgcaatacaaaatgtcagactccgatcggtgcgattaactcaagcatgccctttcataatatccaccctcttaccataggcgagtgcccaaagtatgtgaaaagtaacaagttggtgctggcaacagggctaaggaactctcccctccgggaacgcagaaggaagcggggactgttcggcgccattgctggttttatcgaagggggatggcagggcatggtcgacggctggtacgggtatcatcactccaatgagcagggaagcggttacgccgcagataaagaatcgacccaaaaggctatcgacggcgttacgaataaagtgaactctattatcgataagatgaacactcagttcgaggccgtagggcgcgaatttaataaccttgagcgaagaattgaaaatctgaacaaaaagatggaggacggattcttggatgtgtggacatataatgcggagctcctggtcttaatggaaaacgagaggaccctggacttccacgattccaatgtgaagaacctctacgacaaagttcggcttcagctgcgtgataatgccaaggaattgggcaacggttgttttgagttctaccataaatgcgacaatgaatgtatggagtcagtgcgcaacgggacttatgattaccctcaatatagtgaggaagcaagactaaagagggaggaaataagcggcgtcaaactggagtccatcggaacataccagtctggccggctcgtgccacgagggagccccggatcaggttatattccggaggctcctcgcgacggccaggcctacgtaagaaaggacggggaatgggttctgcttagtacctttctgggaaagcccatcccaaatcctttgctcggcctggattccacgggt

SEQ ID NO: 28410 - RNA, 1704 nt, synthetic construct; identical to SEQ ID NO: 28408
  misc_feature 1..1704: note = derived and/or modified sequence opt3 from anti-influenza_Chain
  source 1..1704: mol_type = other RNA

SEQ ID NO: 28411 - RNA, 1704 nt, synthetic construct; identical to SEQ ID NO: 28409
  misc_feature 1..1704: note = derived and/or modified sequence opt3 from anti-influenza_Chain
  source 1..1704: mol_type = other RNA

SEQ ID NO: 28412 - RNA, 1707 nt, synthetic construct
  misc_feature 1..1707: note = derived and/or modified sequence opt3 from anti-influenza_Chain
  source 1..1707: mol_type = other RNA
gaccagatctgcattggctaccacgccaacaatagcaccgagcaagtggatacaataatggaaaagaacgtcactgttacgcatgctcaggacatcctggagaaaaagcacaatgggaaactctgtgatcttgacggagtgaagcccctgattttgagagattgctccgtagcaggttggttactgggcaaccctatgtgtgacgaatttatcaatgtgccagagtggtcttatattgtcgaaaaagccaacccggtgaatgatctatgctaccccggggactttaacgattatgaggagctcaagcatctgctttcaaggatcaatcacttcgaaaagatacagatcattcctaaaagtagctggtcctctcatgaggcgtcgctgggagtttcaagcgcttgtccataccagggcaagagttcctttttccggaacgtggtctggttgatcaaaaagaactctacctatcccacaattaaacgcagctacaataatactaaccaagaagacctcctggtgctgtggggtatccaccaccctaatgatgccgcagagcagaccaagctctatcagaacccaacaacctacatatccgtagggacttcaacattaaaccagcgactggttccccgtattgccaccagaagtaaggtgaatggacaaagcggcaggatggagtttttctggacgatccttaaacctaacgacgctattaattttgaatctaacggcaatttcatcgcaccagagtacgcctataagatcgtcaaaaagggggattccactattatgaaatcagaattggagtacggaaactgcaataccaagtgtcagacaccgatgggtgctataaacagcagtatgccctttcataatatccaccctctgactattggcgaatgcccaaaatatgtgaagtctaaccggctagtgctcgccaccgggctgcgcaatagcccccagagagagaggcggcgcaagaaacgaggacttttcggcgcgatcgcaggttttatagaagggggatggcagggcatggtcgacggctggtacgggtatcatcactccaacgaacaaggatcgggttacgccgctgacaaggagtctacacagaaagccattgatggcgttaccaataaggtgaactccatcatcgacaaaatgaatacgcagttcgaagcagtagggagagagtttaacaacctggaaaggcggattgagaatttgaacaagaagatggaggatggattcctcgacgtgtggacttataatgctgaactgttagtcctgatggagaacgaacgtacactcgatttccacgactcaaatgtgaaaaacctttacgataaggttcgcctgcaattgagagacaatgccaaagagctaggcaacggttgttttgagttctaccataagtgcgataatgagtgtatggagagtgtgaggaacgggacctatgactaccctcagtatagcgaagaggcgcggctgaaacgagaagagatctccggcgtcaagctcgagtctattggaatataccagagcggccgcctggtgccaagagggtcacccggaagtggttatatcccggaagcccctagggatggccaggcatacgtacggaaggacggggagtgggttcttctgtccactttcttgggaaaacccattccaaatcctctcctgggcttagacagcacaggt

SEQ ID NO: 28413 - RNA, 1707 nt, synthetic construct
  misc_feature 1..1707: note = derived and/or modified sequence opt3 from anti-influenza_Chain
  source 1..1707: mol_type = other RNA
gaccagatctgcattggctaccacgccaacaatagcaccgagcaagtggatacaataatggaaaagaacgtcactgttacgcatgctcaggacatcctggagaaaacccacaatgggaagctctgtgatcttgacggagtgaaacccctgattttgagagattgctccgtagcaggttggttactgggcaaccctatgtgtgacgaatttatcaatgtgccagagtggtcttatattgtcgaaaaggccaacccgacaaatgatctatgctaccccgggtcatttaacgactatgaggagctcaaacatctgcttagtaggatcaatcacttcgaaaagatacagatcattcctaagagctcctggtctgatcatgaggcgtcgtcaggagtgagcagtgcttgtccatacctgggctccccctctttcttccggaacgttgtgtggttgatcaaaaagaatagcacttatcctaccattaaaaagtcctacaacaatacaaaccaggaagacctcctggtcctgtggggtatccaccacccaaatgatgccgcagagcaaacccgcctctatcagaaccccactacatacatatcaattgggaccagtacgttaaaccagcgactggtgcctaaaatcgccactcgtagcaaggtaaatggacagtctggcagaatggagtttttctggaccattcttaagccaaacgacgctatcaattttgaatccaacggcaatttcatcgcaccggagtacgcctataaaattgttaagaaaggggattcagctataatgaaaagcgaattggagtacggaaactgcaatacaaagtgtcaaactcccatgggtgccatcaacagttctatgccttttcataatattcacccactgaccatcggcgaatgccccaagtatgtgaaatccaacaggctagtcctcgcgacagggctgcggaatagccctcagcgcgagtcgagaaggaagaagcggggacttttcggcgcaatagccggttttattgaagggggatggcagggcatggtggacggctggtacgggtatcatcactctaacgaacagggatccggttacgctgccgacaaagagtcaacccaaaaggcaatcgatggcgtgacgaataaagtcaacagtatcattgacaagatgaatactcagttcgaagctgttgggcgcgagtttaacaacctggaacgaagaatcgagaatttgaacaaaaagatggaggatggattcctcgacgtgtggacatataatgccgaactgttagtactgatggagaacgaaaggaccctcgatttccacgacagcaatgtgaagaacctttacgataaagtccggctgcagttgcgtgacaatgcgaaggagctaggcaacggttgttttgagttctaccataaatgcgataatgagtgtatggagtccattcgcaacgggacttataattacccacaatattctgaagaggccagactgaagagggaagagataagcggcgtgaaactcgagtcaatcggaacataccagagtggccggctggttccccgagggtccccgggaagcggttatattcctgaagcaccccgcgacggccaggcttacgtgagaaaggatggggagtgggtccttctgtctacctttttgggaaagccaatccctaaccccctcctgggcttagactcaacgggt

SEQ ID NO: 28414 - RNA, 1707 nt, synthetic construct
  misc_feature 1..1707: note = derived and/or modified sequence opt3 from anti-influenza_Chain
  source 1..1707: mol_type = other RNA
gaccagatctgcattggctaccacgccaacaatagcaccgagcaagtggatacaataatggaaaagaacgtcactgttacgcatgctcaggacatcctggagaaaacccacaatgggaagctctgtgatcttgacggagtgaaacccctgattttgagagattgctccgtagcaggttggttactgggcaaccctatgtgtgacgagttcctaaatgtgtctgaatggtcatatatcgtcgaaaagattaacccagccaatgatctctgctacccggggaactttaataactatgaggagctgaaacatcttctgagtaggatcaatcggttcgaaaagatacagatcattcccaagagctcctggcctgaccacgaggcgtctttgggagtgtcgtcagcttgtccataccagggcggtcccagcttttatcgcaacgttgtgtggctcatcaaaaagaataacacataccctactattaaaaagagttatcataataccaaccaagaagatctgctggtcctctgggggatccaccacccaaacgacgaggccgagcagacacgaatatacaaaaatcccaccacttacatttccgtgggaacatctaccttaaaccagcgtctggtacctaagatcgcaacgagaagcaaggttaatggccagtccggcagggtggagttcttttggactattcttaaatcaaacgataccatcaatttcgaaagtaacgggaattttatcgccccagaaaacgcttataagattgtcaaaaagggagacagcacaataatgaaatctgagttggaatacggtaattgcaacactaagtgtcaaaccccgatcggcgcaattaattcctcaatgcccttccataacatccaccctctgacaataggggagtgcccaaaatatgtcaagagcaatcggctagtgctcgccaccggactgcgcaacagtccccagggcgagagaaggcggaagaaacgcggtctttttggggctattgccggattcatcgaaggcggctggcaggggatggtggatggatggtacggttatcatcactctaatgagcagggctccgggtacgcggcagacaaggaaagcacgcaaaaagccatcgacggagttactaacaaggtgaactcgattatcgataaaatgaatacacagtttgaggctgtaggccgagagttcaacaatctggaaagaaggattgagaacttgaataagaagatggaagacggttttctcgatgtgtggacctataacgccgagctgttagtcctgatggaaaatgagcggactctcgacttccacgattctaacgtgaaaaatctttacgacaaggttcgtctgcagttgcgcgataacgcaaaagaactagggaatggctgtttcgagttttaccatagatgcgacaacgagtgtatggaatccgtgaggaatggaacatatgattaccctcaatattcagaggaagctcggctgaagcgagaggagataagtggcgtcaaactcgaaagcatcgggacctaccagtccggacgcctggtgccaagaggttctcccggcagcgggtatattccggaggcccctagggacggacaggcgtacgtacggaaggatggcgaatgggttcttctgtcaacgttcttgggtaagcccatcccaaaccctctcctggggttagacagtaccggc

SEQ ID NO: 28415 - RNA, 1707 nt, synthetic construct; identical to SEQ ID NO: 28412
  misc_feature 1..1707: note = derived and/or modified sequence opt3 from anti-influenza_Chain
  source 1..1707: mol_type = other RNA

SEQ ID NO: 28416 - RNA, 1707 nt, synthetic construct; identical to SEQ ID NO: 28413
  misc_feature 1..1707: note = derived and/or modified sequence opt3 from anti-influenza_Chain
  source 1..1707: mol_type = other RNA

SEQ ID NO: 28417 - RNA, 1707 nt, synthetic construct; identical to SEQ ID NO: 28414
  misc_feature 1..1707: note = derived and/or modified sequence opt3 from anti-influenza_Chain
  source 1..1707: mol_type = other RNA

SEQ ID NO: 28418 - RNA, 1728 nt, synthetic construct
  misc_feature 1..1728: note = derived and/or modified sequence opt3 from anti-influenza_Chain
  source 1..1728: mol_type = other RNA
atctgcattggctaccacgccaacaatagcaccgaacaggtggacacaataatggaaaagaacgtcactgttacgcatgctcaagatatcctggagaaaacccacaatgggaagctctgtgaccttgatggagtgaaacccctgattttgagagactgctccgtagcaggttggttactgggcaaccctatgtgtgatgaatttatcaatgtgccagagtggtcttatattgtcgaaaaggccaacccggcgaatgacctatgctaccccgggaactttaatgattatgaggagctcaaacatctgctttcaaggatcaaccacttcgaaaagatacagatcattcctaagagtagctggtccgaccatgaggcttcttcgggagtgtcaagcgcctgtccataccagggcacacccagctttttccggaatgttgtgtggctgatcaaaaagaacaatacttatcctaccattaaacgctcctacaacaatacaaaccaggaagatttgctcatcctgtggggtatacaccactctaacgacgcagccgagcaaaccaagctgtatcagaatccaactacatacattagcgtcgggacctccacgctcaaccagcgattagtgcccaaaatcgctactcgttcaaaggtaaatggacagaacggcagaatggatttcttctggaccattctgaagcctaatgacgcaatcaactttgagagtaatggcaacttcatcgccccagaatacgcttataaaattgttaagaaaggggatagcgccatagtgaagtctgaggtcgaatacggaaattgcaacacaaaatgtcaaactccgatcggtgcgattaattcctcaatgccctttcataacatccaccctcttaccataggcgagtgcccaaagtatgtgaaaagcaataagttggtgctggcaacagggctaaggaacagtcccctcggatacattcctgaagccccacgggacggccaggcttatgtccgcaaggacggtgagtgggttctgctttctaccttcctgagatccgataaaacgcatacttgtcccccgtgccctgcccccgagttgctcgggggaccaagcgtgtttctgttccctcccaagccaaaagacacattaatgatctcgaggacccccgaagtaacttgtgtggtcgtggatgtttctcacgaggaccctgaagtgaagtttaattggtacgtcgatggcgtggaggtacacaacgcaaaaacaaagccacgggaggagcagtataactccacctaccgcgttgtgtcagtcctgacggtgctccatcaggactggcttaatggcaaggagtacaaatgcaaggtcagtaacaaagctctgccggcccccatcgaaaagaccattagcaaagcgaaggggcaacctcgagagccacaggtgtatacattgcccccttccagagaagagatgactaagaatcaggtttctctaacctgcctggtgaaaggattctacccaagcgatatcgccgtagaatgggagtcaaacggtcaacccgagaataactataagacaactccgcctgtcctcgacagtgatggctccttctttctgtacagcaaacttaccgtggacaagtctaggtggcagcaggggaatgttttctcatgtagtgtgatgcacgaagcactgcataaccactatacacagaaaagtttgtccctctctccaggaaag

SEQ ID NO: 28419 - RNA, 1728 nt, synthetic construct
  misc_feature 1..1728: note = derived and/or modified sequence opt3 from anti-influenza_Chain
  source 1..1728: mol_type = other RNA
atggtggtcaccagcaacgccgacagaatctgcacaggcattacttcctctaattcaccccacgttgtgaagacggctacccagggggaggtaaacgtgacaggagtcatacctctgactaccacaccaaccaaaagtcatttcgcaaatctcaagggtactgaaacaaggggcaaactttgtccgaagtgcctgaactgtaccgatttggacgtggccttagggcggcccaaatgcacgggaaatatccctagcgcgcgcgtttccattctgcacgaggtgcgaccagtcacttctggctgttttcccatcatgcatgatcgtaccaagattagacaactacctaacctcctgaggggttacgaacacatccggctttcgacacataatgtgataaacgctgagaatgccccagggggaccctataagatcggcacttcaggcagctgccctaacgtaaccaatgggaacggattctttgcaacaatggcctgggctgttccaaagaatgacaacaataagaccgcaacgaacagtctgactattgaagtgccgtacatctgtacagagggtgaggatcagattaccgtctggggcttccactccgacaacgaaactcagatggccaaattgtatggggattctaagccccagaaatttacaagctccgctaatggagtgaccacgcactacgtgtcacaaatcggcggtttccctaaccagaccgaggacgggggactcccacagagtggccgcatagtcgttgattatatggtgcagaaaagcggcaagacagggactattacctaccaaagaggaatcctgctgccccagaaagtatggtgcgcctctggtaagtccaaagtgattaagggctcactccctttaatcggggaagcggactgtctgcatgagaaatatggaggccttaataagagcaaaccatactacacaggtgagcacgcaaaggccatcgggaactgccccatttgggtcaagactccgttgaaactggctaatggcaccaagtataggcctcccgccaaactactcaaggaacggggatttttcggcgcaatagctgggtttctggagggaggttgggaaggcatgatcgccgggtggcatggatacacaagtcacggcgcgcacggtgtggccgttgcagctgatcttaaatctacccaggaggccattaacaagatcactaagaatctgaactccttgagcgaactcgaggtgaaaaatctgcagcgcttatcgggggctatggacgagctgcataacgaaatactcgagcttgatgaaaaggtcgacgacctgcgagccgatacgatttcttcccaaatcgagttggcagtgctactgtcaaatgaaggcatcattaacagtgaggacgagcacctcctggcccttgaaagaaaactgaagaaaatgttgggaccaagcgctgtagagatcggcaatgggtgtttcgaaacaaagcataagtgcaaccagacctgcctcgataggattgcggcaggaacttttgacgccggtgagttctccctgcctacctttgattctttaaatataacagctgccagcctgaacgacgatggcctagacaaccacaccatcctcctgtattactcaactgcagccagttcccttgctgttacattgatgattgccatcttcgtggtctatatggtgagccgggataatgtctcttgtttccattca

SEQ ID NO: 28420 - RNA, 1728 nt, synthetic construct; identical to SEQ ID NO: 28419
  misc_feature 1..1728: note = derived and/or modified sequence opt3 from anti-influenza_Chain
  source 1..1728: mol_type = other RNA

SEQ ID NO: 28421 - RNA, 1728 nt, synthetic construct; identical to SEQ ID NO: 28418
  misc_feature 1..1728: note = derived and/or modified sequence opt3 from anti-influenza_Chain
  source 1..1728: mol_type = other RNA

SEQ ID NO: 28422 - RNA, 1731 nt, synthetic construct
  misc_feature 1..1731: note = derived and/or modified sequence opt3 from anti-influenza_Chain
  source 1..1731: mol_type = other RNA
gccaaggctggcgtgcagagcgtcaaaatggagaagatcgttcttctcttcgcaattgtgtcccttgtaaaatctgaccaaatatgcatcgggtaccacgccaacaattcaaccgaacaggtggatacaattatggagaagaacgtcactgtgacgcatgcgcaggacatcctggaaaagacccacaatggaaagttgtgtgatttagacggtgttaagcccctgattctaagagattgcagtgtggctggctggctcctggggaaccctatgtgtgacgagtttatcaatgtcccagaatggagctatatagtggagaaagccaacccggtaaatgatctttgctaccccggagacttcaacgattatgaggaactgaagcatttgctctccaggatcaatcactttgagaaaattcagatcattcctaagtcttcgtggtcaagccatgaagcaagtctgggcgtttcctctgcctgtccataccaaggtaaaagctccttctttcggaacgtggtctggctgatcaagaaaaattcaacatatcccactataaaacgcagttacaacaataccaaccaggaggacctcttagtgctgtgggggattcaccaccctaatgatgctgcagagcagacaaagctgtatcagaacccaaccacttacatcagcgtgggaacatctaccttgaaccaacgactggtcccccgtattgccacgagatccaaagttaatggccagtcaggcaggatggagttcttttggactatcctaaagcctaacgacgctatcaatttcgaaagcaacgggaattttattgccccagaatacgcgtataaaatagtgaagaaaggagatagtaccatcatgaagtctgagctcgaatacggtaactgcaatacaaagtgtcagactccgatgggcgcaattaactccagcatgcccttccataatatccaccctctgaccataggggagtgcccaaaatatgtaaagtcgaaccggcttgtgctggccacaggattgcgcaattctccccagagagagaggcggcgcaaaaagcgaggcctctttggtgctattgccgggttcatcgaaggaggctggcaaggcatggtcgacgggtggtacggatatcatcactccaacgagcagggttcaggctacgcagctgacaaagaaagtacccagaaggccatcgatggggtgacgaataaggttaacagcattatcgacaaaatgaatactcaatttgaggcggtgggaagagagttcaacaacctggaaaggcggattgagaatttaaacaagaaaatggaagatggcttcctggacgtctggacatataatgccgagctccttgtgctgatggaaaacgagcgtaccttggattttcacgactccaatgtaaagaacctatacgataaagttcgcctgcagctcagagacaatgcaaaggaactgggtaacgggtgtttcgagttttaccataagtgcgataatgagtgtatggaatctgtgaggaacggcacttatgactaccctcagtatagcgaggaagctcggcttaaacgagaggagatatcaggagtcaagctggaaagtatcggcatttaccagatcttgtccatctatagcacagtggcctcttcactcgctctggccttaatggtcgcagggctgagtctatggatgtgcagcaatggatccctccaatgccgcatttgtata

SEQ ID NO: 28423 - RNA, 1731 nt, synthetic construct; identical to SEQ ID NO: 28422
  misc_feature 1..1731: note = derived and/or modified sequence opt3 from anti-influenza_Chain
  source 1..1731: mol_type = other RNA

SEQ ID NO: 28424 - RNA, 1737 nt, synthetic construct
  misc_feature 1..1737: note = derived and/or modified sequence opt3 from anti-influenza_Chain
  source 1..1737: mol_type = other RNA
atggtggtcaccagcaacgccgacagaatctgcacaggcattacttcctctaattcaccccacgttgtgaagacggctacccagggggaggtaaacgtgacaggagtcatacctctgactaccacaccaaccaaaagtcatttcgcaaatctcaagggtactcaaacaaggggcaaactttgtccgaactgcctgaattgtaccgatttggacgtggccttagggcggcccaagtgcatgggaacgatccctagcgcgaaggcttccattctgcacgaagttaaaccagtgacttctggctgttttcccatcatgcatgatcgcaccaagattcgacagctacctaacctcctgcgtggttacgagaatatcagactttcggccaggaacgtcataaatgcagaaacagccccagggggaccctatatcgtgggcacttcaggcagctgccctaacgtaaccaatgggaaaggattctttgctacaatggcatgggccgttccaaagaacaaaaataagaccgctacgaacccgctgactgtggaggtcccctacatttgtacaaaaggtgaagaccagatcaccgtgtggggcttccacagtgataatgaggcccagatggtgactttgtatggggactccaagcctcaaaagtttacatctagcgcgaacggagtcaccacgcattacgtttcccagattggcggtttcccaaaccagaccgaggatgaagggctccagcaatcaggacggatcgtggtagactatatggtgcagaaacccggcaagacaggcactatagtctaccagcgcggggtgctgctgcctcagaaagtttggtgcgcaagtggaagaagcaaggtgattaaaggttctctcccattaatcggcgaggccgattgtctgcacgaaaagtatgggggacttaataaatccaagccctactacaccggcgagcacgctaaggccattggtaactgcccgatctgggtcaaaacacctttgaagctggcaaatgggactaaatataggcccccagctaagctactcaaagagcggggctttttcggagccatcgcgggctttctggaagggggatgggagggtatgattgccggctggcatgggtacacctcacacggagcacatggcgtggctgtagccgctgaccttaagagcacacaagaagccataaacaagatcaccaaaaatctgaacagtttgtctgagctcgaagttaagaatctgcagcgcttatccggtgcaatggatgagctgcacaacgagattctcgaacttgacgagaaagtggatgacctgcgagccgacactatcagctcgcagatagaattggctgtcctactgtctaatgaggggattatcaactccgaagatgagcacctcctggcgcttgagagaaagctgaaaaagatgttgggcccttcagcagtggacatcggaaatggctgtttcgaaacgaagcataaatgcaaccaaacatgcctcgataggattgccgctgggacctttaatgccggagagttcagtctgcccacttttgacagcttaaacatcaccgcagcctccctgaatgatgacggtctagataaccacacaattctcctgtattactctaccgctgccagctcacttgcagtcactttgatgatagcgatcttcattgtgtatatggttagtcgggacaacgtgttcctgctccatctgtccatccgtaag

SEQ ID NO: 28425 - RNA, 1737 nt, synthetic construct; identical to SEQ ID NO: 28424
  misc_feature 1..1737: note = derived and/or modified sequence opt3 from anti-influenza_Chain
  source 1..1737: mol_type = other RNA

SEQ ID NO: 28426 - RNA, 1731 nt, synthetic construct
  misc_feature 1..1731: note = derived and/or modified sequence opt3 from anti-influenza_Chain
  source 1..1731: mol_type = other RNA
atggagaccatcagcctgattacaatactccttgtggtcactgcctccaacgctgacaagatctgcattggccaccagtctaccaattcaaccgaaacagttgatactctgaccgagacaaacgtgcccgtaacccatgcaaaagaattgttacacactgagcataatgggatgctgtgtgccacaagtctaggacaccctctcatcctggacacgtgcacgattgaaggtcttgtgtacggcaacccaagctgtgatctgttgctcgggggaagagagtggtcctatatcgtcgagaggtcttcggcggtgaatggcacttgctacccgggtaacgttgaaaatctggaggaactgcggaccctcttctcaagcgctagttcctatcaacgcatacagatctttcccgacacaacttggaacgtgacctacacagggacctctcgagcctgtagcggatccttctatcgttcaatgagatggttaacgcagaagagtggcttttaccctgtccaggatgcacaatatactaataacaggggcaaaagcattctgttcgtgtgggggatccatcacccacccacatacaccgagcagactaatctttacattcggaacgacacaaccacgtctgtaaccacagaggatttgaatcgcacttttaagcctgttatcggaccaagacccctggtgaacggtctacagggcaggatagactattactggtccgtcctcaaacctgggcagaccctgcgggtgcgctcaaatggaaaccttattgccccatggtatggccacgtgctgagcggtgggagtcatggacgaatcttgaagacagatctcaagggcggcaactgcgtcgttcaatgtcagactgaaaaagggggactgaatagtaccttaccgttccacaacatttccaagtacgcttttggtacatgccccaaatatgtgagagtaaatagcctgaagctcgcagtgggccttaggaacgtccctgcccggtcgtctcgtgggctgttcggagctatcgccggctttatcgagggtgggtggccaggcttggtggcgggatggtacggcttccagcattccaatgaccagggggttggaatggcagccgatcgcgactcaacccaaaaagctattgataagataacttctaaggtgaacaatatcgtcgacaaaatgaacaagcagtatgaaattatcgaccacgagtttagcgaagtggagacgagactaaatatgataaacaataaaattgatgaccagatccaagatgtatgggcctacaacgcagagctgctcgttctgcttgaaaatcagaagacactggacgagcacgatgctaacgtgaataacttgtacaacaaagtcaagagggccctcggttccaatgcgatggaagacggcaaagggtgtttcgagctgtatcataagtgcgatgaccagtgtatggaaaccatccggaacggaacttacaatcgacgcaagtatagagaggagtctaggttagaacggcagaaaattgagggcgtgaagctggaaagcgagggtacctacaaatcagggcgcctagtccccagaggcagtcctggatccggctatatcccagaagcccccagggatgggcaagcatacgtgcgtaaggacggagagtgggttctcctgagcacatttcttggtaaaccgattcctaaccccttgctgggcctcgattctaccggg

SEQ ID NO: 28427 - RNA, 1731 nt, synthetic construct; identical to SEQ ID NO: 28426
  misc_feature 1..1731: note = derived and/or modified sequence opt3 from anti-influenza_Chain
  source 1..1731: mol_type = other RNA

SEQ ID NO: 28428 - RNA, 1752 nt, synthetic construct
  misc_feature 1..1752: note = derived and/or modified sequence opt3 from anti-influenza_Chain
  source 1..1752: mol_type = other RNA
atgaaggccatcattgtgctgctcatggtcgttaccagcaacgctgacagaatatgcacaggcatcacttcctctaattcaccccacgtggtaaaaacggcaacccagggggaggtgaacgtcacaggagtgattcctcttactaccacaccaaccaagagtcatttcgccaatctgaaaggtactcaaacaaggggcaagttgtgtccgaactgctttaattgtaccgatttagacgttgcgctggggcggcccaaatgcatgggaaacacgcctagcgctaaggtgtccatcctacacgaagtcaagccagccacttctggctgtttccccattatgcatgatcgcaccaaaatccgacagctccctaatctgcttcgtggttacgagaacataagactgtcgacatcaaatgtgatcaacactgaaaccgcaccagggggaccctataaggtaggcacaagcggcagttgccctaatgttgccaacgggaatggatttttcaacaccatggcttgggtgattccaaaagacaataacaagacggcaatcaacccggtcactgtggaggtgccctacatttgttccgaaggtgaggatcagatcacagtctggggctttcactctgacgataaaacccagatggagaggttgtatggggacagcaatcctcaaaagttcacttcctcagccaacggagttacaacccattacgtgagtcagataggcggttttccaaatcagacggaagatgaggggctcaagcagagcggacggattgtagtggactatatggtccaaaaacccggcaagaccggcacaatcgtgtaccagcgcgggattctgctgcctcagaaagtttggtgcgcttctggaagatccaaggtgatcaaaggttcactcccattaatcggcgaagccgattgtctgcacgagaagtatgggggacttaacaaaagcaagccctactacactggcgagcacgcgaaggcaattggtaattgcccgatatgggtcaaaacccctttgaagctggccaacgggacaaaatataggcccccagctaagctactcaaagaacggggcttctttggagccatcgcaggcttcctggaagggggatgggagggtatgattgctggctggcatgggtacacaagtcacggagcccatggcgtggcggtagccgcagaccttaagtctacccaggaggctatcaataagataactaaaaacctgaattatttgtccgaactcgaggttaagaacctgcaacgcttaagcggtgccatgaatgagctgcacgatgaaattctcgagcttgacgaaaaagtggacgatctgcgagctgacaccatctcgtctcagatcgagttggccgtcctactgtccaacgaagggattatcaattcagaggatgagcacctcctggcacttgaaagaaagctgaaaaagatgttgggccctagtgccgtggagattggaaacggctgttttgaaactaagcataaatgcaatcagacgtgcctcgacaggatagctgcggggacattcaacgcaggagattttagcctgcccaccttcgactccttaaacatcactgccgcttctctgaatgatgacggtctagataaccacaccattctcctgtactatagcacagccgcatcaagtcttgccgtcaccttgatgatcgctatcttcattgtgtacatggtttcccgggacaatgtgagctgttctatatgcctg

SEQ ID NO: 28429 - RNA, 1752 nt, synthetic construct
  misc_feature 1..1752: note = derived and/or modified sequence opt3 from anti-influenza_Chain
  source 1..1752: mol_type = other RNA
atgaaggccatcattgtgctgctcatggtcgttaccagcaacgctgacagaatatgcacaggcatcacttcctctaattcaccccacgtggtaaaaacggcaacccagggggaggtgaacgtcacaggagtgattcctcttactaccacaccaaccaagagttacttcgccaatctgaaaggtactaagacaaggggcaaattgtgtccggattgcttaaactgtaccgacctggatgttgcgctagggcggcccatgtgcgtgggaacgactcctagcgctaaggcctccatcctccatgaagtccgcccagtgacctctggctgttttcccattatgcacgaccgaacaaagatccgtcaactggcaaatcttctgagaggttatgagaacataaggttgtcgactcagaatgtaatcgatgccgaaaaagctcctgggggaccataccggctcggcacctcaggcagctgccccaacgcaacaagtaagtccgggttctttgccaccatggcttgggccgttcctaaagacaataacaagaatgcgacgaacccactgactgtggaggtcccgtatatttgtacagaaggagaggatcagatcaccgtgtggggtttccattctgacgataaaactcagatgaagaatctgtacggcgacagcaacccccaaaagtttacatcctcagcaaatggggtgaccacgcactatgtcagtcagattggaggcttccctgatcagaccgaggacggtgggctcccacagagcggacgcatcgttgtggattacatgatgcaaaaacccggcaagacaggcactatagtatatcagagaggggtgttactgcctcagaaagtctggtgcgcctctggaaggtccaaggtgattaaaggttcacttccattgatcggcgaagctgactgtctgcatgagaagtacgggggactaaacaaaagcaagccctactataccggcgaacacgccaaggcaattggtaactgcccgatctgggttaaaacacctctcaagctggctaatgggactaaataccggcccccagccaaacttctgaaggagcgcggctttttcggagcgatcgccggctttttggaagggggatgggaaggtatgattgcaggctggcacgggtataccagtcatggagctcacggcgtggccgtcgctgccgacctcaagtctacacaggaggcaataaacaagatcaccaaaaatctgaactccttaagcgaactggaggtgaagaatctccaacgactttcgggtgccatggatgaactgcataacgagattttggagctagacgaaaaagtagatgacctgagagctgatactatctcttcccagatagagctcgcggttctgctttcaaatgaagggattatcaacagtgaggacgaacacctgttggcactcgagaggaagctgaaaaagatgttaggccctagcgccgtggatatcggaaatggctgtttcgagacgaagcacaaatgcaaccagacatgcctggaccggattgctgccgggacctttaatgcaggagagttctccctacccacttttgattctctcaacatcaccgccgctagcctgaatgacgatggtcttgacaaccatacaattttgctgtactattcaaccgccgcaagttccctcgcggtcactctgatgcttgctatattcatcgtgtacatggtcagccgtgacaatgtgtcttgttcaatttgcctg

SEQ ID NO: 28430 - RNA, 1752 nt, synthetic construct
  misc_feature 1..1752: note = derived and/or modified sequence opt3 from anti-influenza_Chain
  source 1..1752: mol_type = other RNA
atgaaggccatcattgtgctgctcatggtcgttaccagcaacgctgacagaatatgcacaggcatcacttcctctaattcaccccacgtggtaaaaacggcaacccagggggaggtgaacgtcacaggagtgattcctcttactaccacaccaaccaagagttacttcgccaatctgaaaggtactaggacacggggcaagttgtgtccggattgcttaaactgtaccgacctggatgttgcgctagggcgccccatgtgcgtgggaacgactcctagcgctaaagcctccatcctccatgaagtcaagccagtgacctctggctgttttcccattatgcacgaccgaacaaagatccgtcaactgcctaatcttctgagaggttatgagaacataaggttgtcgactcagaatgtaatcgatgcagaaaaagccccagggggaccctaccggctcggcacctcaggcagctgccctaacgctacaagtaagtccgggttctttgcaaccatggcctgggctgttccaaaagacaataacaagaatgccacgaacccgctgactgtggaggtcccctatatttgtacagaaggagaggatcagatcaccgtgtggggtttccattctgacgataaaactcagatgaagaatctgtacggcgacagcaaccctcaaaagtttacatcctcagcgaatggggtgaccacgcactatgtcagtcagattggcagcttcccagatcagaccgaggacggaggtctcccccagtctgggcgcatcgttgtggattacatgatgcaaaaacctggaaagacaggcactatagtatatcagagaggcgtgttactgccacagaaagtctggtgcgcatccgggaggtcaaaggtgattaaaggaagccttcccttgatcggtgaagccgactgtctgcatgagaagtacggcgggctaaacaaaagtaagccgtactataccggagaacacgctaaggccattggcaactgccctatctgggttaaaacacccctcaagctggcaaatggtactaaataccggcctccagctaaacttctgaaggagcgcgggtttttcggcgccatcgcgggatttttggagggcgggtgggaaggaatgattgccggttggcacggctatacctctcatggggcacacggagtggctgtcgccgctgacctcaagtccacacaggaggccataaacaagatcaccaaaaatctgaacagcttatcggaactggaggtgaagaatctccaacgactttctggcgcaatggatgaactgcataacgagattttggagctagacgaaaaagtagatgacctgagagccgatactatctcctcacagatagagctcgctgttctgcttagtaatgaaggtattatcaacagcgaggacgaacacctgttggcgctcgagaggaagctgaaaaagatgttagggccctccgcagtggagatcggcaatggatgtttcgaaacgaagcacaaatgcaaccagacatgcctggatcggattgccgctggcacctttaatgccggggagttctctctaccaacttttgacagcctcaacatcaccgcagcctcactgaatgatgacggacttgataaccatacaattttgctgtactatagtaccgctgcctccagcctcgcagtcactctgatgcttgcgatattcatcgtgtacatggtctctcgtgacaatgtgtcatgtagtatttgcctg

SEQ ID NO: 28431 - RNA, 1752 nt, synthetic construct; identical to SEQ ID NO: 28428
  misc_feature 1..1752: note = derived and/or modified sequence opt3 from anti-influenza_Chain
  source 1..1752: mol_type = other RNA

SEQ ID NO: 28432 - RNA, 1752 nt, synthetic construct; identical to SEQ ID NO: 28429
  misc_feature 1..1752: note = derived and/or modified sequence opt3 from anti-influenza_Chain
  source 1..1752: mol_type = other RNA

SEQ ID NO: 28433 - RNA, 1752 nt, synthetic construct; identical to SEQ ID NO: 28430
  misc_feature 1..1752: note = derived and/or modified sequence opt3 from anti-influenza_Chain
  source 1..1752: mol_type = other RNA

SEQ ID NO: 28434 - RNA, 1758 nt, synthetic construct
  misc_feature 1..1758: note = derived and/or modified sequence opt3 from anti-influenza_Chain
  source 1..1758: mol_type = other RNA
atgaaggccatcattgtgctgctcatggtcgttaccagcaacgctgacagaataatctgcacaggcattacttcctctaattcaccccacgtggtaaaaacggcaacccagggggaggtgaacgtcacaggagtgatccctcttactaccacaccaaccaagagtcatttcgccaatctgaaaggtactgaaacaaggggcaagttgtgtccgaaatgcttaaactgtaccgatctggacgttgcgctagggcggcccaagtgcacgggaaatattcctagcgctcgcgtgtccatcctccacgaggtccgaccagtgacttctggctgttttcccataatgcatgatcgtaccaagatcagacaactgcctaaccttctgaggggttacgaacacattcggttgtcgacacataatgtaatcaacgccgagaatgcaccagggggaccctataaaattggcacttcaggcagctgccctaacgttaccaatgggaacggattctttgccacaatggcttgggcagtgccaaagaatgacaacaataaaaccgccacgaacagtctcactatcgaagtcccgtacatatgtacagagggtgaggatcagattaccgtgtggggcttccactccgacaacgaaactcagatggctaagctgtatggggattctaaaccccagaagtttacaagctccgccaatggagtgaccacgcactacgtctcacaaatcggcggtttccctaaccagaccgaggacgggggactgccacagagtggccgcattgttgtggattatatggtacaaaagagcggcaaaacagggactatcacctaccagagaggaatcctcttaccccagaaggtgtggtgcgcgtctggtaggtccaaagtcattaagggctcactgcctcttataggggaagcagactgtttgcatgagaaatatggaggcctgaataagagcaaaccatactacacaggtgagcacgccaaggctatcgggaactgccccatttgggtgaagactccgctaaaactcgccaatggcaccaagtatcggcctcccgcaaaactgcttaaggaacgcggatttttcggcgctatcgccgggtttctggagggaggttgggaaggcatgatagcggggtggcatggatacacaagtcacggcgcccacggtgttgcagtggctgccgatttgaaatctacccaggaggctattaacaagatcactaagaatctcaactccctgagcgaattagaggtcaaaaatctgcagcgactctcgggggccatggacgagcttcataacgaaatcctggagttggatgaaaaggtggacgacctaagagcagatacgatttcttcccaaatcgagctggccgtactcctgtcaaatgaaggcattataaacagtgaggacgagcaccttctggctttggaaaggaaactcaagaaaatgctgggaccaagcgcggttgagatcggcaatgggtgtttcgaaacaaagcataagtgcaaccagacctgcttagatcggattgcagccggaacttttgacgctggtgagttctccctgcctacctttgattctctaaatatcacagccgcaagcctcaacgacgatggcctggacaaccacaccatccttttgtattactcaactgccgctagttccctggccgtgacactcatgattgcaatattcgtcgtgtatatggtcagccgtgataatgtgtcttgttcaatctgcctg

SEQ ID NO: 28435 - RNA, 1758 nt, synthetic construct; identical to SEQ ID NO: 28434
  misc_feature 1..1758: note = derived and/or modified sequence opt3 from anti-influenza_Chain
  source 1..1758: mol_type = other RNA

SEQ ID NO: 28436 - RNA, 1749 nt, synthetic construct
  misc_feature 1..1749: note = derived and/or modified sequence opt3 from anti-influenza_Chain
  source 1..1749: mol_type = other RNA
atggaggccagactgctcgtgcttctgtgcgctttcgcagccaccaacgcggacacaatctgtattggctaccacgctaataacagcactgatacggtcgacaccgttttggaaaagaatgtgacagtaactcattccgtgaacttactggaggattctcacaatgggaaactatgcaagctcaaaggaatagctcccctgcagcttggtaagtgtaacatcgcaggctggctgttggggaatcctgaatgcgacctcctgctgaccgcctcaagttggagctatattgtcgagacatccaactctgaaaatggaacctgttacccaggcgattttatcgactatgaggagctcagggaacaattatcgtcagtgagcagtttcgagaaatttgaaattttcccgaagacttcctcttggcccaaccatgagacaaccaagggtgttacggctgcatgcagctacgccggggcttcctcattttatcggaatctgctttggttgactaaaaagggaagtagctaccctaaactgtctaagtcctatgtgaacaataaaggcaaggaggtcctagtgctctggggcgtacaccatccacccaccgggacagatcagcagtcactgtaccagaacgccgacgcgtacgttagcgtgggaagttctaagtataatcgccgattcactcctgaaatcgcagcccgtccaaaagtcagagatcaagctggtaggatgaactactattggacccttctggagcccggcgacacaataacctttgaagccacggggaacttgatcgcaccttggtacgctttcgccctcaatcggggatccggcagcggtattatcacttcggatgcgccagtgcacgactgtaacacaaagtgccagaccccgcacggggccattaattcttccctgccctttcagaacatccatcctgtgactataggagagtgtccaaaatatgtccgctcaacaaagttaagaatggcaaccggcctgaggaatattcccagtatccagagccggggcctcttcggggctattgccggatttatcgaaggtggctggacggggatgatcgatggatggtacggctatcaccatcaaaacgagcagggttccgggtacgctgccgaccagaaatctacccagaatgcaattgacggcataacaaacaaggttaatagcgtgatcgagaaaatgaacactcaattcaccgccgtaggaaaggaatttaataaccttgagcgccgaattgaaaatctgaacaagaaagtggatgacggcttcttggatatctggacatacaatgctgagctactggtcctcctggaaaacgagagaactcttgacttccacgattcaaacgtgaggaatctgtatgagaaggttaaaagtcagttgaagaacaatgcgaaagaaatagggaacggatgctttgagttctaccacaagtgtgacgatgcatgcatggaatccgtgcggaatggtacctatgactaccctaagtatagcgaggaatctaaactcaaccgtgaggagattgatggcgtcaagctggaatcaatgggggtgtaccagagtggacgcttagtaccaagaggcagccccggttccgggtatatcccggaggcccctagggacggccaagcctacgttcggaaagatggagaatgggtgctgctatctacatttctcggcaagcccatcccaaatcctctgcttgggttggactcgaccgga

SEQ ID NO: 28437 - RNA, 1749 nt, synthetic construct; identical to SEQ ID NO: 28436
  misc_feature 1..1749: note = derived and/or modified sequence opt3 from anti-influenza_Chain
  source 1..1749: mol_type = other RNA

SEQ ID NO: 28438 - RNA, 1755 nt, synthetic construct
  misc_feature 1..1755: note = derived and/or modified sequence opt3 from anti-influenza_Chain
  source 1..1755: mol_type = other RNA
atggagagaaccgtgctgctccttgccacagtcagcctggttaagtccgaccagatctgcattggctaccacgctaacaattctactgaacaagtggatacgataatggagaaaaacgtaaccgtgacacatgcacaggacatcttggaaaggactcacaatgggaagttatgtgatctgaacggagtcaaacccctaattctccgggactgctcagtggccggttggctgcttggcaatcctatgtgtgatgagttcatcaacgttccagaatggagttatattgtggagaaggcgagcccggctaatgacctgtgctaccccgggaactttaatgattatgaggaattgaaacatctcctgtcccgcatcaaccacttcgagaagatacagatcattcctaagtcttcgtggtcaaatcatgacgccagcagtggagtctcctctgcatgtccatacctgggccgaagctcctttttccgtaacgtggtatggctcatcaaaaagaactcagcctatcccaccattaaaagaagttacaataatacaaaccaggaagatttactggttctttggggtgtgcaccaccctaacgacgctgcagagcaaaccaagttgtatcagaatccaactacatacatcagcgtcgggacctctacgctgaaccagaggctagtgcccgagatagccactcggcctaaagtgaatggacagtccggccgcatggaatttttctggaccattctcaagccaaacgatgctatcaattttgagtcaaacggcaatttcattgccccggaatacgcgtataagatcgtcaaaaagggggacagcacaatcatgaaaagtgagctggaatacggaaactgcaatactaagtgtcaaacccccatgggtgcaattaactcttccatgccttttcataatatacacccacttacaatcggcgagtgccccaaatatgttaagagcaacagactggtgttggccaccgggctcaggaatacgcctcagcgggagcgccgaaggaaaaagagaggactgttcggcgctattgccggttttatcgaagggggatggcagggcatggtagatggctggtacgggtatcatcactcgaacgagcagggatcttgttactccgcagacaaggaatcaactcaaaaagctatagacggtgtgacaaataaggtcaacagtattatcaacaaaatgaatacccagttcgaggccgtgggccgggaatttaacaatttagagcgtcgcatcgagaacctgaataagaaaatggaagatgggttcctcgacgtttggacttataacgcggagcttctggtgttgatggaaaatgagagaacactagatttccacgacagcaacgtcaagaatctgtacgataaggtgaggctccagctgcgggacaacgccaaagaacttggaaatggctgctttgagttctaccataagtgtgataacgagtgcatggaatccgttaaaaatggtacctatgactacccacaatattctgaggaagcacgactgaaccgcgaggagattagcggggtaaagttggaatcaatgggcacgtaccagagtggaagactcgtgcccaggggctccccggggagcggatatatccctgaggctccccgggatggtcaggcctacgtccgcaaagacggcgaatgggtgctgttatctacctttctggggaagccaattcctaatcccctactcggactggattcaacaggc

SEQ ID NO: 28439 - RNA, 1755 nt, synthetic construct; identical to SEQ ID NO: 28438
  misc_feature 1..1755: note = derived and/or modified sequence opt3 from anti-influenza_Chain
  source 1..1755: mol_type = other RNA

SEQ ID NO: 28440 - RNA, 1947 nt, synthetic construct
  misc_feature 1..1947: note = derived and/or modified sequence opt3 from anti-influenza_Chain
  source 1..1947: mol_type = other RNA
atgggcgacaagatcaacttcatttttgggatacacaatcatcagcccctgggaaacttcggttgggtgtttgaggaagcctacgagaaatgctattggcctttcctcgaaacccttgaggaatacccaaatatgaaggtcgctatccacacaagcggcccgctgattgagtggttgcaagataacagacccgagtatatcgacttactgaggtccctagttaaacggggacaggtggaaattgtagtggcagggttttacgagcctgtcctcgcctctatcccaaaggaagatcgcatagagcagatccgactgatgaaagagtgggcgaagtcaattggcttcgacgctcgtggtgtgtggcttactgaaagagtttggcagcccgagctggtgaagacgttgaaagaaagtgggatcgattatgtcattgtggacgattaccattttatgagcgccggactctccaaggaggaactgtattggccttactacaccgaggacggcggcgaggtaatcgcagttttcccaatagatgaaaaactgaggtatctcattccctttcggcctgtggacaaggtcttagagtacctgcactctcttatcgatggggacgaatcgaaagtggccgtgttccatgatgacggagagaagtttggtatttggccaggcacatatgaatgggtctacgagaaggggtggttgcgcgagttctttgacagaatctcaagcgatgaaaagatcaatctgatgctatatactgagtacctcgaaaagtataaaccgaggggactggtttaccttcccattgctagttacttcgagatgtccgaatggtctctgcctgcaaagcaagcccggttgttcgtggagtttgtaaacgagctcaaagtgaagggcatattcgaaaaatatcgcgtctttgtgcgaggtgggatctggaagaatttcttttacaagtatccagagagcaactacatgcacaaaagaatgctgatggtttccaagttagtgaggaataaccccgaagctcggaaatatctgctccgtgcccagtgtaatgacgcgtactggcacggacttttcggcggcgtctatctgcctcatttgcgcagagcaatttggaacaatctaatcaaggccaactcatacgtgagtctggggaaagtaataagggatattgactacgatggatttgaggaggttctcatcgaaaatgacaacttctatgctgtgtttaagccaagctacggtggctctctggtcgagttctcctcaaagaaccggcttgtgaattatgtcgatgtgctggcccgacgctgggaacactaccatgggtatgttgagagccagtttgacggagtggcaagtatccacgaattggagaaaaagattcccgatgagatcagaaaagaagtagcttacgacaagtataggcggttcatgctccaggatcacgtcgtgccgctgggcaccacattagaggactttatgttctctcgccaacaggaaattggtgagttccctagagttccctactcctacgaactgctagacgggggcataaggctcaaacgtgagcatctgggaatcgaggtggaaaagaccgtcaaacttgtgaacgatggctttgaggtagaatatattgtgaataacaaaactgggaatccagttttgttcgccgtcgagctgaacgtggcggtgcagagcatcatggaatcgcctggagtcctccggggtaaggagatcgttgtggacgataaatacgccgtgggcaagtttgcactgaaattcgaggacgaaatggaggtatggaagtatcccgtcaagacactttctcagtccgaatcagggtgggatctgattcaacagggagtgagttacatagttccaatccgattggaggacaaaattagatttaagctcaaattcgaggaagctagcggc

SEQ ID NO: 28441 - RNA, 1947 nt, synthetic construct
  misc_feature 1..1947: note = derived and/or modified sequence opt3 from anti-influenza_Chain
  source 1..1947: mol_type = other RNA
atgagcagaatgaccctgaagtcctctatgaaaaagagggtgctctcacttctgatcgccgtcgttttcttgagtttaacaggcgtgtttcccagcgggctgattgagactaaagtatccgctgcaaagataacggaaaactaccagttcgactctcggatccgcctaaattcgattggatttatccctaaccacagcaaaaaggccaccattgcggctaattgctcaacattctatgtggtcaaggaggatggtactatcgtgtacaccggcacagccaccagtatgtttgacaacgatactaaagaaacagtttatatagcagacttctcctctgtgaatgaggaagggacctactatctcgccgtcccaggagtgggcaagagcgtaaactttaaaatcgctatgaatgtttacgaggatgcattcaagacggccatgctgggtatgtatcttctgcgatgtgggacttccgtgtcagctacctacaacgggattcattacagtcacggcccgtgccatacaaatgacgcctatttggattacatcaacggccaacacactaaaaaggacagcaccaaggggtggcatgatgcgggagactataataaatacgtcgtgaacgcaggtattacagtgggctctatgtttctcgcctgggagcacttcaaggatcagctggaacccgtcgctctggagatccctgagaaaaataactccataccagactttctcgatgaattaaagtatgagattgactggatcctgaccatgcagtaccccgacgggtcaggacgtgttgcccacaaagtgagcacgagaaatttcggcggttttattatgcctgaaaacgagcatgatgaaaggttcttcgtaccatggagttctgcagctactgccgactttgtggcgatgacagccatggcagctcggatcttccgcccctatgatcctcagtacgccgagaagtgtatcaacgctgccaaagtctcctacgaatttcttaagaataacccagcaaatgtgttcgccaaccaaagcgggttttcgaccggagagtatgctactgtttctgacgcggatgacagattgtgggcagccgctgagatgtgggaaacactgggcgatgaggaatacctaagggacttcgagaatcgggccgcacagttttccaagaaaattgaagccgatttcgactgggataacgtggctaatctcggcatgtttacctatctgctttcagagcgcccggggaagaaccccgccctggtccagagtataaaagacagcttgctctccacggcagactctatcgtgcgaaccagccagaatcacggatacggtagaacactgggcactacctattactgggggtgcaacggaacagtagttaggcaaactatgattttacaggtggcgaataagatctcacctaacaatgattatgtcaacgctgccctggacgcaataagtcatgtgttcggccggaattactacaaccgttcctatgtcaccggtctcgggattaacccacccatgaatcctcacgatcgcagaagcggcgccgacggaatctgggagccatggcccggctaccttgtgggaggaggttggccgggccctaaagattgggttgacatccaggattcttatcagacaaacgaaattgctatcaattggaacgccgcactgatttacgctttggccgggtttgtgaattataactcaccccaaaatgaggtactatacggagacgtcaacgatgacggcaaggtgaatagtaccgatctgactctcctgaagaggtatgttcttaaagcggtgagcacgctgccatcctctaaggccgagaaaaacgctgacgtcaatcgggatggtcgagtgaactcgagcgacgtaacaatattgtcccgctacctcatcagagtgattgaaaagctgcctatc

SEQ ID NO: 28442 - RNA, 1947 nt, synthetic construct; identical to SEQ ID NO: 28440
  misc_feature 1..1947: note = derived and/or modified sequence opt3 from anti-influenza_Chain
  source 1..1947: mol_type = other RNA

SEQ ID NO: 28443 - RNA, 1947 nt, synthetic construct; identical to SEQ ID NO: 28441
  misc_feature 1..1947: note = derived and/or modified sequence opt3 from anti-influenza_Chain
  source 1..1947: mol_type = other RNA

SEQ ID NO: 28444 - RNA, 2046 nt, synthetic construct
  misc_feature 1..2046: note = derived and/or modified sequence opt3 from anti-influenza_Chain
  source 1..2046: mol_type = other RNA
atgaagcccagccacttcaccgagaaaagatttatgaagaaagtgctgggcctcttccttgtcgttgtgatgctggcctccgtaggggtgttgcctacatctaaggtccaggctgcaggaactacggtgacctcaatggaatactttagtccagccgacggtccggttatcagcaaatccggcgtggggaaggcgtcttatggattcgtcatgcccaagtttaacggcggttcggctacatggaatgatgtgtactcagacgtaggggttaacgtgaaagtcggaaataactgggtggatattgaccaggccggcggctatatatacaatcagaactgggggcattggagcgatggaggtttcaatggctattggtttactttaagtgcaaccacagagatccagctgtactccaaggccaacggggtgaaactagaatatcagctcgtcttccaaaatattaacaagaccactatcacagctatgaatcctacccagggaccacagattacggcatcttttactggcggtgccgggttcacctaccccacatttaacaatgacagcgctgttacttacgaggccgtggcggatgacctgaaagtatatgtgaagcctgtcaactcctcaagttggatcgatatagacaataacgcagccagcggatggatctacgatcacaacttcggccagtttaccgacggcgggggaggttattggttcaatgtgacagaatctattaacgttaaacttgagtccaagacctcaagcgctaatctggtgtacacgatcactttcaacgagccaacaaggaatagttatgtcattaccccctacgaaggcactacatttaccgccgatgcaaacgggtctatcggaatacctttgccaaagattgacggcggtgctccgatcgccaaagagctcgggaatttcgtgtatcaaattaacatcaatggccagtgggtagacctgtccaacagctcgcagtctaagtttgcgtactccgccaatggatacaacaatatgtcagatgcaaaccagtggggctattgggctgactacatctatgggctgtggttccaacccattcaggaaaatatgcagatacggatcggataccctctcaacggtcaagccggcgggaacattggaaataactttgttaattatacgttcatcggcaacccaaatgctccccgccctgatgtgagtgaccaggaggatataagcattggtaccccaacagaccccgccatcgcagggatgaacttaatctggcaggatgagtttaatggcactaccctggacacatccaaatggaactacgaaactggatattaccttaataacgatccggccacctggggctgggggaatgctgagttgcagcattacacaaactctacccaaaatgtctatgtgcaggacggaaagctgaacattaaagcgatgaatgatagcaagtcattccctcaggaccccaaccgatacgcacagtatagttccggtaagatcaacactaaagacaagctaagcctcaaatacggccgtgtcgattttagagccaagctgccaacgggggacggagtgtggcctgctctttggatgctgcccaaagattctgtttatggcacatgggccgcatcaggtgaaattgacgtgatggaggccagggggcggttgccaggcagtgtaagcggaaccatacacttcggcgggcaatggcccgtcaatcagtcctctggaggcgattaccattttcctgaaggtcagactttcgctaacgactatcacgtgtactcggttgtgtgggaggaggataatatcaagtggtacgtcgacgggaagtttttctataaagtgaccaaccagcaatggtacagcacagccgcaccaaataacccgaatgcgcccttcgatgaacctttttatctcattatgaacctggctgtaggaggcaatttcgacggtggccgcaccccaaacgcctccgatatccccgcaactatgcaagtggactacgttagagtctataaggagcag

SEQ ID NO: 28445 - RNA, 2046 nt, synthetic construct; identical to SEQ ID NO: 28444
  misc_feature 1..2046: note = derived and/or modified sequence opt3 from anti-influenza_Chain
  source 1..2046: mol_type = other RNA

SEQ ID NO: 28446 - RNA, 2058 nt, synthetic construct
  misc_feature 1..2058: note = derived and/or modified sequence opt3 from anti-influenza_Chain
  source 1..2058: mol_type = other RNA
atgaccaagagcatctacttctccctgggcattcacaaccatcagcccgtggggaattttgacttcgtcatagagagagcctatgaaatgtcttacaaacctctcatcaactttttctttaagcacccagatttcccgattaatgttcatttttcaggattccttctgttgtggttagagaaaaaccaccccgaatattttgagaagctgaaaatcatggctgaaaggggtcaaattgagttcgtgagtggcgggttttacgagcctatcctaccaataatccccgacaaggataaggtacagcagattaaaaagctcaataaatatatctacgacaagttcggacagacacctaaaggcatgtggctggcagaacgggtgtgggagccacatcttgtcaagtatattgccgaagcgggtatcgagtacgtggttgtggatgacgctcactttttcagcgtcgggctgaaggaggaagatttgttcggatactatctcatggaggaacaaggctacaaactggccgtgtttcccatatccatgaagctgcgctatctcattcctttcgcagacccagaggaaactatcacgtacttagataaatttgcctctgaggacaagtcgaaaattgctctgcttttcgatgacggcgagaagtttgggttgtggccggatacctatcgaacagtatacgaagagggatggctggaaactttcgtttcaaaaatcaaggagaactttctactcgtgacccccgtcaatctgtatacatacatgcagcgtgtgaagcctaaaggtagaatctaccttccaaccgcaagctatagggaaatgatggagtgggtgctgttccccgaggcccagaaggaattggaggaactcgtcgagaaactgaagactgaaaacttatgggacaaatttagtccttacgttaagggcgggttctggcggaattttctggctaagtatgacgagtccaaccacatgcagaaaaagatgctctacgtgtggaaaaaggtacaagattctccaaatgaggaagtgaaagagaaggccatggaagaggtcttccagggacaggcgaacgacgcatattggcatggcatttttggtgggctttacctgccccacttgcgcacagccatatatgagcatctaatcaaggctgaaaattacctggagaacagcgaaattagattcaatatcttcgattttgactgcgatggaaacgacgagataattgtggaatccccgttctttaacctctacctgtcacctaatcacggcggcagtgttcttgagtgggatttcaaaaccaaggcctttaacctgacgaatgtgttgactaggcggaaagaggcatatcacagcaagctctcttacgtcacctccgaagctcaggggaaatcaatccatgagcgctggacagccaaggaagagggactggaaaacatcttattctatgacaatcaccgaagagtgagctttactgagaagattttcgagagtgaacccgtactggaggatctatggaaagactcttccaggctcgaagttgatagcttttacgagaactatgactacgaaatcaataaggacgagaacaaaattcgggtgctgttctcgggtgtctttcgtggcttcgagctttgtaagtcttatatattgtacaaagataagtcctttgtggacgtcgtgtacgaaatcaaaaatgtttcagagaccccaattagtctgaacttcgggtgggaaatcaatctcaacttcctggcgcctaatcatcccgattattactttcttatcggagaccaaaagtatccactgagctccttcggcattgagaaggtgaacaattggaaaatattttctggtatcgggattgagttggaatgcgtactcgatgtcgaggccagcctgtaccgctatcccatcgaaacagtgtcattaagtgaggaaggcttcgagagagtttaccagggatccgcactgattcacttttataaggtggacctacctgtcggcagcacctggaggacgactatccggttctgggtgaaa

SEQ ID NO: 28447 - RNA, 2058 nt, synthetic construct; identical to SEQ ID NO: 28446
  misc_feature 1..2058: note = derived and/or modified sequence opt3 from anti-influenza_Chain
  source 1..2058: mol_type = other RNA

SEQ ID NO: 28448 - RNA, 2115 nt, synthetic construct
  misc_feature 1..2115: note = derived and/or modified sequence opt3 from anti-influenza_Chain
  source 1..2115: mol_type = other RNA
atgcccaccaacctgttctttaatgcccaccatagccctgtgggcgctttcgcatcctttacactcgggttcccaggaaagtctggtggccttgacctggagttggccagaccgcccaggcagaacgtcttaatcggggttgaatcactgcacgagagtggactataccatgtgctcccttttctggaaactgcggaggaagatgagagcaaacggtatgacattgagaatccagatcccaaccctcaaaagccaaatatacttatccccttcgctaaagaagagattcagcgcgaatttcacgtagccacggacacctggaaggcaggcgatctgacattcactatctactcccctgtgaaagccgtcccaaacccggagaccgctgacgaggaagagttgaagctcgcactggtgcccgccgttattgtggaaatgacaatcgataataccaacggtactcgagctcgtagagcctttttcgggtttgagggaacagacccttatacctctatgaggcggatagatgacacgtgcccacagctgcgcggcgtcggccaggggagaatcctctcgattgtgtcaaaggatgaaggagtaaggagcgcgttacatttcagtatggaggacatcctgactgcacaacttgaggaaaattggacctttggtttgggcaaagttggggccctgattgtggatgtccccgctggagagaagaaaacataccagttcgccgtgtgtttctatcggggcggttacgtgactgcagggatggacgcttcctatttttacacccgcttctttcagaacatcgaagaggtcggactatacgccctcgaacaggcggaggttctgaaggagcaatctttccgaagcaataaacttatagaaaaggagtggctgtccgacgatcagacatttatgatggcccacgcaattagatcatattacggcaacacccagttgctcgaacacgagggcaagcctatctgggtggtaaatgaaggggagtataggatgatgaacacgttcgacctgactgtggatcagttatttttcgagctgaaactcaatccatggacagtcaagaacgtgcttgacctgtacgttgaacggtatagttacgaggatcgtgtgcgctttcccggagaagagaccgagtatccgagcggtatttctttcactcatgacatgggcgtcgctaacacattttccagacctcactactcaagctacgaattgtatgggatcagtggatgcttctctcatatgacccacgagcagctagtgaattgggtactgtgtgccgctgtttacatcgaacaaacgaaagattgggcctggagggacaagcggctcgcaattctggagcagtgccttgaatccatggtgcgacgcgatcaccccgacccagagcaaagaaacggcgtcatgggtctggatagcaccaggacaatgggcggggccgagataactacctatgactcgttggacgtgtctctcggacaggctcggaataacctgtacttagcgggcaaatgttgggcagcctatgtcgctctggaaaagctatttcgcgatgtggggaaagaggaactcgccgcactggccggagagcaggctgaaaagtgcgccgcaacaatcgtttcccatgtgactgacgatggttacattcctgcgatcatgggcgaggggaatgactcaaagataattcccgctatcgagggacttgtattcccatatttcaccaactgtcacgaagccttggatgagaatggcagatttggtgcatacatccaggccctgaggaaccatctccaatacgtcctgcgtgaagggatttgccttttccccgacggcggatggaaaatcagtagcacatccaataactcttggctgagcaagatttatttgtgtcagtttatagctcggcacatcctcggctgggagtgggatgaacaggggaaacgagccgacgcagctcatgtggcctggctgacccaccctactttatcaatttggagttggtccgatcagatcatcgcgggagagattacgggtagcaagtactatccaagaggcgttacatctatactgtggctagaggaaggggag

SEQ ID NO: 28449 - RNA, 2115 nt, synthetic construct; identical to SEQ ID NO: 28448
  misc_feature 1..2115: note = derived and/or modified sequence opt3 from anti-influenza_Chain
  source 1..2115: mol_type = other RNA

SEQ ID NO: 28450 - RNA, 2148 nt, synthetic construct
  misc_feature 1..2148: note = derived and/or modified sequence opt3 from anti-influenza_Chain
  source 1..2148: mol_type = other RNA
atggaggacttcgtgagacagtgctttaaccccatgatcgtcgaactggccgagaaggctatgaaagaatacggcgaggatctcaagattgaaaccaataaattcgcagccatatgtacacaccttgaggtttgctttatgtatagcgacttccattttatcaacgagcaaggggaatccattatcgtggagcctgaagatccaaatgcgctgttgaagcacaggttcgagattatcgagggacgggaccgcactatggcttggacggtagtgaactctatatgtaataccacaggtgccgaaaaaccgaagtttttacccgatctgtacgactataaggagaaccgattcatcgaaattggcgtcactcgtagagaggtgcatatctactatctagaaaaagcaaataagattaaatcagagaagacccacatccatatatttagtttcacaggggaggaaatggccaccaaagctgattacactctcgacgaggaaagcagggcacggattaagacacgcctgtttaccatcagacaggagatggcctccaggggactttgggattctttccggcagtcggaacgcggcgaggagacgattgaagaacgatttgaaatcactggtaccatgagaaggctggctgaccagtcattgcctccaaacttcagctgcctcgagaatttccgggcctatgttgatgggtttgaacccaacggatacatcgagggcaagctgagtcaaatgtccaaagaggtgaatgcgcgtattgaacctttcctgcgcacaactccaagacccataaggctccctgacggcccaccgtgttttcagcggtctaagttcttactgatggatagccttaaattgtccatcgaggacccctcacacgaaggggagggtattcctctgtacgacgcaatcaagtgcatgcgaacctttttcggatggaaagagccaagtgtcgtgaagccccacggcaaagggataaaccctaattatctactcagctggaagcaggtactggccgaacttcaggatattgagtctgaagagaagatcccacgcaccaaaaacatgaagaaaacatcccaactgaagtgggctttgggagaaaatatggcccccgagaaagttgactttgatgactgtaaggatatctcagacctcaagcagtacgatagcgacgagccggaactgagaagtttatcttcctggattcagaacgagttcaacaaagcatgcgaactgacggatagcatctggattgagctcgacgaaataggcgaggatgtggctcctatcgagcatattgcctcgatgaggcggaattattttactgcggaagtctctcactgtcgcgccacagagtacatcatgaagggtgtgtatatcaacaccgcacttctgaatgcttcctgcgccgctatggacgacttccagttgattcccatgatatcaaaatgtagaactaaggaagggaggcgtaaaacaaacctatacggatttatcattaagggccggagtcatctgcgaaatgataccgacgtggtcaacttcgttagcatggagttttccctcacggatccaagactggaacctcacaagtgggagaaatattgcgtgcttgagatcggcgacatgctgttgaggtctgccattgggcaagtaagccgccccatgttcctctacgtgcggaccaatggaacatcaaagatcaaaatgaagtggggtatggaaatgagaaggtgcctgttacagagtctgcagcaaatagagtccatgatcgaagcagagagctctgtcaaagagaaggatatgactaaggagttctttgagaaccgctcagaaacctggccaattggcgagagtcccaaaggggtggaagagggaagcatcggcaaggtttgtcgaacactactcgccaaatccgtgttcaattctctgtacgcttcgcctcagcttgagggttttagcgcggaatcccggaagttgctgctcattgtccaggcactgcgtgacaaccttgagccagggactttcgatctgggcggattgtatgaagccatcgaggaatgcctcataaatgacccgtgggtgctgttaaacgcttcatggtttaatagtttcctgacccacgccctaaga

SEQ ID NO: 28451 - RNA, 2148 nt, synthetic construct; identical to SEQ ID NO: 28450
  misc_feature 1..2148: note = derived and/or modified sequence opt3 from anti-influenza_Chain
  source 1..2148: mol_type = other RNA

SEQ ID NO: 28452 - RNA, 2256 nt, synthetic construct
  misc_feature 1..2256: note = derived and/or modified sequence opt3 from anti-influenza_Chain
  source 1..2256: mol_type = other RNA
atgaacatcaatccctacttcctgtttattgacgtgcctatacaggccgctatcagcaccacattcccatatactggcgtcccgccctactcccacgggacgggaaccggttatacaattgatactgttatcagaacccatgagtactctaacaagggcaaacaatatatttcagacgtgacagggtgcgtaatggtggatcctaccaatggaccactccccgaagacaacgagcctagtgcatacgcccagcttgattgtgtcctggaagcgttggacaggatggatgaggaacacccaggcttatttcaggctggtagccagaatgccatggaggcactgatggtgactacagttgacaagctaacccaagggcggcagacgttcgattggactgtgtgccgcaaccagcccgccgctaccgcactcaatacaactatcacctcctttcgactgaacgaccttaatggagccgataaaggcggcctggtccctttctgtcaggacataatcgattctttggacaagccagagatgattttcttcacagtgaaaaacatcaagaagaaactcccggctaagaatcgtaaagggtttctgattaagagaatccccatgaaagtaaaggacaggataacccgggttgaatatattaagcgcgccctgtcgctcaacacgatgactaaagatgcggagagaggaaagttaaaaaggcgggcaatcgccacagctggtattcaaatccgcggcttcgtgctggtcgtggaaaatcttgccaagaacatctgcgagaatttggagcagtcagggctgcctgtgggaggcaacgaaaagaaggcaaaactaagcaacgctgtcgccaagatgctcagtaattgtccacccggtgggatttccatgaccgttactggagacaacacaaagtggaatgagtgcctgaaccctcgaatatttcttgcgatgaccgaaagaatcacgagggattctccaatttggttccgggacttttgtagcatcgcccccgtgctgttctccaataaaatagcacgtttgggcaagggcttcatgattacctcaaaaacaaagcgcctcaaagctcagatcccgtgccctgatctgtttaacatccccttagagagatacaatgaagagactagggccaagctgaagaaactcaagccattctttaacgaggaagggaccgctagtcttagccctggaatgatgatgggtatgttcaatatgctgtctacagtattgggcgtggccgcactagggattaaaaacatcggaaataaggagtacctgtgggacggcctccagtcctcagatgactttgccctgttcgtcaacgctaaagatgaagagacttgtatggaaggtattaatgacttttatcggacctgcaaacttctggggataaacatgagcaagaaaaagagttactgtaatgagacaggcatgttcgagtttacctctatgttctatcgagatggatttgtgtccaacttcgcgatggaattgcccagctttggcgttgcaggggtgaacgagtcggccgacatggctatcggaatgactattatcaaaaataacatgatcaataacggtatgggcccagccacggcacaaacagccattcagctctttatagctgactaccgctatacctacaagtgccatagaggggattctaaagtcgaaggaaagaggatgaagatcattaaagagctgtgggaaaatactaagggccgggacggtttactggtggccgatgggggccccaacctatataatctccgcaacctgcacatccctgagattatccttaaatacaatataatggacccagagtacaagggaagattgctgcatccgcagaaccccttcgtaggccacctctccatcgaagggattaaagaggcagatatcacccctgcgcacggaccaattaagaaaatggactatgatgctgtttcaggtacacatagttggaggaccaagcgtaatcggagcatcctgaacactgaccaacgaaatatgatacttgaggaacagtgctacgccaagtgttgcaacctgtttgaggcatgtttcaattccgcctcttatagaaaacccgtgggccagcacagcatgttggaagctatggcccataggctccgcatggatgcacggctggactacgagtcagggagaatgagtaaggaagattttgagaaagctatggcccacttaggagaaattggctatatg

SEQ ID NO: 28453 - RNA, 2256 nt, synthetic construct; identical to SEQ ID NO: 28452
  misc_feature 1..2256: note = derived and/or modified sequence opt3 from anti-influenza_Chain
  source 1..2256: mol_type = other RNA

SEQ ID NO: 28454 - RNA, 2265 nt, synthetic construct
  misc_feature 1..2265: note = derived and/or modified sequence opt3 from anti-influenza_Chain
  source 1..2265: mol_type = other RNA
atggccgtggacatcaagaaaattataaagcagatgaccctggaggaaaaagctggcctctgcagcgggcttgatttctggcacacaaagcccgtcgagagactgggaatcccttccattatgatgactgacggtccacatggcttgaggaaacaacgggaagatgcagagatcgccgacattaacaattctgttccggcgacgtgttttccctcagctgccgggttagcatgcagttgggatcgcgaactggtggagcgagtaggagccgctctaggcgaggaatgtcaggcagagaacgtgagcatcctcctgggtcctggggccaatataaagcgttccccactttgcggaagaaacttcgaatacttttctgaggacccctatctgtcgtcagagttggctgccagccacatcaagggcgtccagagtcagggcgtgggggcgtgtctcaaacatttcgcagccaataaccaagaacacaggcggatgaccgttgatacaattgtggacgagcgcactctgagagaaatctactttgcttccttcgagaatgccgtcaagaaagcaaggccttgggtggtaatgtgcgcttataacaagctgaatggagaatactgttctgagaaccggtatctcttaaccgaggttctgaaaaatgaatggatgcatgatggttttgtggtcagcgactggggcgccgtgaacgatcgcgtgtccgggcttgacgcgggattggatctggagatgccaacatcacacggcattaccgacaagaagatcgtcgaagccgttaaaagtggtaagctaagcgagaatatactcaaccgagcagtggaacgcattctgaaagtaatcttcatggctcttgagaataagaaagagaacgcccagtacgacaaggatgctcaccataggctggcccggcaggcagccgctgaatctatggtgttgctcaaaaacgaggacgatgtcctgcccttaaagaagtccgggactattgcgctgatcggagcatttgtgaaaaagcctcgttatcagggctcaggcagcagtcacatcacaccaacccgcctcgacgatatttacgaagagatcaaaaaggccgggggagacaaagttaatcttgtgtactctgaaggttatagactggagaacgatggcatagacgaggaattgattaatgaggctaagaaggccgcatccagctcggatgtcgccgtggtattcgctgggctaccggacgaatacgagtctgagggatttgataggacgcatatgtccatccccgaaaaccaaaatcggctgatagaggccgttgcagaagtgcagtcaaacattgtcgtggtcctcctgaatggcagtcctgtggagatgccatggatcgacaaagttaagagcgtgcttgaagcgtatctgggtgggcaggctttgggcggagccctcgcagacgtactgttcggcgaggtcaacccctccgggaaattagccgagacttttcctgtgaagctgtctcacaatccaagctacctaaacttccccggagaagatgaccgagttgagtataaagaaggtctcttcgtgggctaccgctattacgataccaaggggatcgagccgctgtttcctttcggacacggcctttcatacacaaagtttgaatatagtgacatttccgtcgataaaaaggacgtgagcgataattctatcattaacgtatcagtgaaagttaagaatgtcggtaaaatggctgggaaggagatagtgcagttgtacgtgaaggacgtcaaaagtagcgttagaaggcccgagaaggaactgaaaggcttcgagaaggtgtttctcaacccaggagaagagaaaactgtgaccttcacactggataagcgggcctttgcatattacaatacccaaatcaaagactggcatgtagaatccggcgagttccttattctgatcgggagatcttcgagagatatcgtcttgaaggagagcgtgagggttaactccacggtgaagattcgtaaacggtttactgtcaactcagctgtggaagacgttatgagtgattctagcgccgcggccgtgctcggacctgtactgaaggagataacagacgctttacagatcgacatggataatgcacacgacatgatggccgctaacattaaaaatatgcccctgcgatccctagtcggttattcacagggcagactcagcgaagagatgctggaggaacttgtggataagatcaacaatgtggag

SEQ ID NO: 28455 - RNA, 2265 nt, synthetic construct; identical to SEQ ID NO: 28454
  misc_feature 1..2265: note = derived and/or modified sequence opt3 from anti-influenza_Chain
  source 1..2265: mol_type = other RNA

SEQ ID NO: 28456 - RNA, 2277 nt, synthetic construct
  misc_feature 1..2277: note = derived and/or modified sequence opt3 from anti-influenza_Chain
  source 1..2277: mol_type = other RNA
atggagagaatcaaggaactgaggaacctcatgagccagtcccggacccgcgagattcttacaaaaactacggtggaccacatggccataatcaagaaatacacctctggccgacaagaaaagaatcccgctctgcgtatgaaatggatgatggcaatgaagtatcctattacagccgataagagaatcactgagatgattccagaaaggaacgagcaggggcagaccttgtggtcaaaaatgaatgacgcgggaagtgatcgggtcatggttagcccgttagctgtgacatggtggaaccgcaatggtcccatgaccaacactgtacattaccctaagatctataaaacatacttcgagagagtggaaaggctgaagcacggcacctttgggccagtccatttccggaatcaggtgaaaatacgccgaagagttgacatcaaccccggacacgccgatctatccgcaaaggaggcccaagacgtgattatggaagtcgtgtttcctaatgaggtaggcgctaggatcctcacgtctgagtcgcagctgactattaccaaggagaaaaaggaggaacttcaggattgcaaaatctcaccactgatggttgcatatatgttggagcgggaactcgtgcgtaagacacgcttcctgcccgtcgccggtgggactagcagtgtgtacatagaggtgctgcatctcacccagggaacatgttgggagcaaatgtatacccctggcggcgaagtcaaaaacgacgatgttgaccagtccttaattatcgctgccagaaatattgtgaggcgggcggcagtatctgccgatccactggctagccttttggagatgtgccactccacgcagatcgggggaatccgaatggtggacattctgaagcagaacccgactgaagaacaagccgtcggtatatgtaaagcagctatgggcctacgcatctcaagtagcttttctttcgggggatttacattcaagagaacctccggctcaagcgtgaagagggaagaggaggttctcactggtaatctgcagacacttaaaattcgggtgcacgaagggtacgaggaatttaccatggtcggacgcagagccacggcgatcctgaggaaggccacccgtcggttgatacagctcattgtgagtggccgagatgagcaatctatcgcagaagctatcattgtagccatggttttctcccaggaggactgcatgatcaaagctgtgagaggcgacctgaactttgtcaatagggccaaccagcgcttaaaccccatgcatcagctgctccggcacttccaaaaggatgcaaaagtgctttttcagaattggggagtcgagcctattgacaacgtgatggggatgataggtatcctgccagatatgacacccagcattgaaatgtcgatgagaggcgttaggatctctaagatgggggtggacgagtactcctcaactgaacgcgtagtcgtgagtatcgatcgattcttgcgggttcgtgaccagagaggaaatgtgctactgagccctgaggaggtctccgaaacccagggcacagagaagctcactattacctattctagctcaatgatgtgggaaataaacggtccagagagtgtgctggtaaatacataccaatggatcattaggaactgggaaaccgtgaaaatccagtggtcccagaatcccactatgctttataacaagatggagttcgagccgtttcagagcctggttcctaaagccattcgcgggcaatactctggcttcgtccggacgttgtttcagcagatgagagatgtgctcggaacattcgacaccgctcagatcataaagctgttaccctttgcggcagccccacctaaacaatcaaggatgcagttcagtagctttactgtgaatgtccgaggctccgggatgcgcatcctggttcggggaaactctcccgtgttcaattataacaaggctaccaagagactaacagtgctcggtaaagatgccggcaccctgactgaagacccagatgaggggacagcaggagtagaatcggccgtccttaggggctttttgattctgggtaaggaggaccgtcgctacgggcccgctctcagcatcaatgaactgtccaaccttgccaaaggcgagaaggcaaatgtgctgattggacagggcgacgttgtgttggtcatgaaacggaagagagattcaagtatcctcacggactctcaaaccgcgactaagaggatacgaatggctattaac

SEQ ID NO: 28457 - RNA, 2277 nt, synthetic construct; identical to SEQ ID NO: 28456
  misc_feature 1..2277: note = derived and/or modified sequence opt3 from anti-influenza_Chain
  source 1..2277: mol_type = other RNA

SEQ ID NO: 28458 - RNA, 2472 nt, synthetic construct
  misc_feature 1..2472: note = derived and/or modified sequence opt3 from anti-influenza_Chain
  source 1..2472: mol_type = other RNA
atgatgctgagaaagaaaaccaagcagctcatcagctccattcttatactggtgttgttactgtctctattccccgccgctctcgcagccgagggcaacacaagggaagacaattttaaacatctgcttgggaacgataatgtcaagcggccttcagaggcgggagctctgcaattgcaggaagttgacggtcagatgactctcgtggatcagcacggcgagaaaatccaactgcgcgggatgagtacgcacggactgcagtggttcccagaaattctcaacgacaatgcctacaaggcattaagcaacgattgggactccaatatgatccgactggccatgtatgtaggcgagaacggttacgctaccaatccggagcttattaagcagcgtgtgatcgatgggatagaattggcaatcgagaacgacatgtatgtcattgtggattggcatgttcacgcccccggagaccctagagatccagtgtacgctggcgccaaagactttttcagggaaatcgcggcactgtatcccaataaccctcatattatctacgagctagccaatgagccatcttcgaacaataacggcggggctggaatacccaacaatgaagagggttggaaggccgtcaaagaatatgcagatcctattgtggagatgctccggaagtcaggcaacgctgacgacaatatcattatcgtagggagcccaaactggagtcagcgcccggatctggccgcggacaatcccatcgatgaccaccacacaatgtacactgttcatttttacaccggatcccacgccgcatctacagaaagctatccttccgagaccccaaactcagagagaggcaatgtgatgagtaacactaggtacgctcttgaaaatggtgtcgccgtgttcgctacagagtgggggaccagccaagcctctggagatggcggcccctattttgacgaagcagatgtgtggattgagttcctgaacgaaaataacatatcctgggccaattggtcattgacgaacaaaaatgaggtcagcggggcttttactcctttcgagctcggaaagagtaacgcgaccaacctggacccaggtcccgatcatgtttgggcaccggaagagttatctctgtccggcgaatacgtgcgggcccgcatcaagggggtaaattatgagcctattgaccgaacaaaatacactaaggtgctctgggattttaacgacggaaccaaacagggcttcggtgtcaatagcgactcgcccaacaaggaacttatcgctgtggataatgagaacaatacactgaaagtttctgggttggacgtgtccaacgatgtctcagacggcaatttttgggccaacgcaagactaagtgccaatggatggggcaagagcgtggatatactgggggctgagaaactcaccatggacgtaattgttgatgaaccaacgactgtggccatcgcagcgatccctcagtcctctaagagcggatgggctaaccccgagagggccgtccgggtgaatgcagaagacttcgtccagcaaacagatggtaagtataaagccggcctgaccattactggggaggacgctccaaaccttaagaatatcgccttccacgaggaagataacaacatgaataacattatactgtttgtgggaacagacgcagctgatgttatctacttggacaatattaaagtgatcggcaccgaggtagaaatccccgtcgtgcacgaccctaagggtgaggccgttctcccatcagtgttcgaagatgggacgcgtcagggctgggactgggcgggagagagtggcgtcaaaaccgccctgacaattgaggaagctaacgggtccaatgcattaagctgggagtttggatacccggaagtgaagccctctgataactgggccactgctcctcgcctggacttctggaagtcagatctagtaagaggtgagaatgactatgtggcctttgatttctacctcgacccagttagggcaaccgaaggcgcgatgaacataaatctggtctttcagccccctacaaacgggtattgggtgcaagccccaaaaacttacaccatcaatttcgatgagcttgaggaagctaaccaggtgaatggattgtatcattacgaggtcaagattaacgttcgggacatcacaaatattcaggatgacaccctgctccgaaacatgatgatcatatttgccgatgtggaaagtgacttcgcaggccgcgtgtttgtagacaacgtcagattcgagggtgctgccactacggaacccgtggagccggagcctgttgatccaggggaagagacaccccctgtggacgaaaaagaggcaaagaaagagcagaaggaagccgagaaggaagagaaagaagctgtcaaggaggagaaaaaggaagcgaaagaggaaaagaaggccgtgaaaaatgaggcaaagaaaaag

SEQ ID NO: 28459 - RNA, 2472 nt, synthetic construct; identical to SEQ ID NO: 28458
  misc_feature 1..2472: note = derived and/or modified sequence opt3 from anti-influenza_Chain
  source 1..2472: mol_type = other RNA

SEQ ID NO: 28460 - RNA, 3063 nt, synthetic construct
  misc_feature 1..3063: note = derived and/or modified sequence opt3 from anti-influenza_Chain
  source 1..3063: mol_type = other RNA
atggccggcccccacagaagcagggctgcagggcctccaccgttcgccgtggacgagcatgtcgcgctggaaatggttgcttttcggggagaggtgttcgccggtcacggcctccttgcagatcagcgcctgatcgcccataccgggcgacccgctttgaacgcacaacgtattacacagcagaagcagagagaccaatgcaggggacagcggcaccgccatcaccagggcggtagaaatttaaggaaagcccaccggacttttcatgaacaccagtccacgcaagatcaggctcatgacgcccctcacgggcagcaggcgaagaccggacacgagggcctgggccatgaacacgcacaagcccagcatcagcaagggcagtctaacgtagtggatcgccaggacggagagccagtcgaggctcagcaccaaaaagatggtgcccagcgagcaggcaatgctcccgccgggagagtggaactagagcagcagcctgttgaagcgcaacatcagcagcaggagggagacgtgaggataggcaagcggcgtcaaaacgccttcgcaccacccgctctcgatcacgtccacggtgggcctggacgcctgcagagacatggccttgccgtggagaggcacgtaccagctgttcagcagcatcaacagcgggtgcagcgaggccgccaacagatcgaccacgtcctggggcacggattgccgggtagacagaggctcgcctttcgggatggcccccgcagacctgtgggggtggcatcaccagtcctgggacagaggccctgtcctggccatcgtattgttcaaaatctgttccggcacggtatcgacccatgccgagtggggagatgtaggcgcagtcccagcgaactccatggcatgggatgcgccgatgtacgggctagaggccacgggaggcatatgcgcggacagcgagacgagcacccgggtcggggccgtccttgtgcgagaaggcgccacgtggacgatgaccgggatagaacaccccaggaaaaattatacgacgtcgcaagggggctggatgagccagcccgacgcgtgcattttgacgatgaagctgaccggtccgttttcagaggacttgcccagcctgcacccgatgagccagagggcaggcgtcgcgaccggttggtgctgcaaagacagtctgtcaaccacaggcgaggtcggctatcgcgccatagacagcagcaccaaccccagcagcaaaggcctcatgggaatcaggcctttctcggcaagtatgaaaagcggcgaagaaaaccaactgcttgcctgaagtcacttcgcaggttcccggataaagacgcccccgtgctgtactttgtaaaccagttggagaagaccaaacgtcggatgacactcctgttagtttggctgattttcaccggagtggcaggcgaaatcagactcgaggcggaagacggggagcttctgggagtcgctgtggatagcactttgacaggttatagtggcagggggtacgtcaccggatttgacgcccctgaggattccgtgcgcttctctttcgaagcaccacgaggcgtttatagagtggtatttggtgtcagcttctcctcacggtttgccagttacgctctaagggtggacgattggcaccagacggggagcctgataaagcgcggcggaggcttctttgaggcctctatcggggaaatttggctcgacgagggagcacacactatggctttccaactgatgaatggcgcccttgattatgttcgtctggaacccgtgtcctacggtcctccagcgagacccccggcccagttgtcagacagccaggctaccgcaagtgcccaggctctctttgccttcctgttatctgagtacgggcggcatatcctggcaggacaacagcagaacccttataggcgcgattttgacgcgattaattacgtccgaaacgtgacaggcaaggagccagccctagtatccttcgatctcatcgactatagccccactagagaagctcacggtgtggttcattaccagacccctgaggattggatagcctgggcaggccgggacgggattgtctcgctgatgtggcactggaatgctcccacagaccttatcgaagatccatctcaagactgttattggtggtacggattttataccaggtgcacgactttcgatgtggccgcagccttggctgacacatcctcagagcgctacagactgctcctgagggatattgacgtgatcgcggcccagcttcagaaatttcagcaagcagatatccctgtcctgtggcggcccttgcacgaggctgccggcgggtggttctggtggggagccaagggcccagaaccgttcaaacagctctggcgtctgttatacgagcgcctggttcatcaccatggtctacacaacctcatttgggtgtatacccatgaacctggggctgcagagtggtaccccggagacgcctatgtggatatagtaggccgagacgtctacgcggatgacccagatgctctgatgagaagtgactggaatgaacttcagactttgtttggtggcaggaagctggtggccctcacagagaccgggacgctgcccgacgttgaggtgatcaccgattatggaatttggtggagctggttctccatctggacagacccatttttacgggatgtcgaccctgatcgcctgactagagtgtaccactctgaaagggttcttacccgggacgagttgcccgattggcgaagctatgtgctccacgcaacaactgtacaacctgccggcgacctggctctagcagtctacccgaacccaggggccggaagactgcatgtggaagtgggcctccccgtcgcggctcctgttgtggtagaggtgttcaacctgcttggtcagcgcgtctttcagtaccaggccgggatgcaaccagcaggattgtggaggcgggccttcgaactggctttagcccccggcgtgtatctcgttcaggtgcgtgcaggtaatctggtcgctagaaggcgctgggtgtcagttcgg

SEQ ID NO: 28461 - RNA, 3063 nt, synthetic construct; identical to SEQ ID NO: 28460
  misc_feature 1..3063: note = derived and/or modified sequence opt3 from anti-influenza_Chain
  source 1..3063: mol_type = other RNA

SEQ ID NO: 28462 - RNA, 3165 nt, synthetic construct
  misc_feature 1..3165: note = derived and/or modified sequence opt3 from anti-influenza_Chain
  source 1..3165: mol_type = other RNA
atgagaaagaaaaggcggggcttcctgaacgccagcaccgctgtgctcgtcgggatccttgcaggatttctgggtgttgtgttggccgcgacaggcgctttagggttcgccgtacgcgagtccctgctactcaagcagtttctgttcctttcttttgaaggaaatactgacggcgcatcacccttcggtaaagatgtggtcgtgacggccagtcaagacgttgctgcagatggggagtacagcctgaaggtggaaaaccgaacctccgtctgggacggagtggagattgatttgacaggcaaagtaaatactggcaccgactatctcctgtcttttcacgtttaccagacatcggattcacctcagctgttcagcgtgctcgcccgtaccgaagacgagaagggggagagatataagatattagctgataaagtcgtggtgccaaactactggaaggaaatcctggtcccgtttagtcccactttcgagggaacccctgccaaattttcccttattatcacatctccaaagaaaacggacttcgttttctatgtggataatgtacaggtgttgactcccaaggaagcgggtcctaaggtcgtgtacgagaccagcttcgagaaaggcattggggactggcaaccaaggggatccgatgttaagatctcaataagtcccaaagtggcacatagcggcaagaaatctctgttcgtctccaaccggcagaagggttggcacggggcccagatctcactaaaaggaatactcaagacaggcaagacttatgcttttgaagcctgggtgtaccaggagagcggccaagaccagaccatcattatgacaatgcagcgcaaatacagttctgactccagcaccaagtatgaatggatcaaagcagctacggtaccttcggggcagtgggttcaactgtctggaacttacacaataccagccggtgtgaccgtcgaggatcttactctgtatttcgaatcccagaatccgacattggagttttacgtggacgatgtcaaggtggttgacaccacgtcagcggagattaaactcgaaatgaaccccgaggaagagatccctgccctgaaggatgtgttaaaggactatttcagagtaggcgtcgcactgccaagtaaagtgtttattaatcagaaggatatcgctctcatcagcaaacattccaactctagcaccgccgaaaatgagatgaagcccgactcacttctggctgggattgagaacggaaaattgaagttcaggtttgaaacagccgataagtacatagagttcgcacaacagaatggcatggttgtgcggggtcacactctagtctggcataaccagacccctgaatggtttttcaaagacgagaatgggaacctgctcagtaaggaagagatgacagagcgcctgcgagaatatatccacactgtggtaggccactttaaaggaaaggtgtacgcctgggatgttgtcaacgaggctgtggacccaaatcagcccgacggccttagaaggtccacctggtaccaaattatggggccggattatatcgaactggcgttcaaatttgcacgggaggccgaccctaacgctaagttgttctacaatgattataacacattcgagcccaagaaacgtgacataatttacaatctcgtgaaaagcctgaaagaaaagggattaatcgatggtatcggcatgcagtgccatatttctctggccaccgacatccgccagattgaggaagcaattaaaaagttttcaactatcccagggattgagatccacatcacggaactagatattagtgtctatagagacagcacatccaactactctgaggcccctaggaccgctctcatagagcaggcccataaaatggcacaactgttcaagatctttaagaaatattcgaatgttattactaacgtgaccttctggggacttaaggatgactacagctggcgggcgacacgacgcaatgattggcccttgatctttgacaaagattaccaggctaagctggcctattgggcaattgtggccccagaagtactgccccctctcccaaaagagtccaagatctcagaaggcgaggctgtcgtggttggtatgatggacgacagttacatgatgtctaagccgatagaaatctatgatgaggaggggaacgtgaaagccaccattagagcaatctggaaggacagcactatttacgtctatggcgaagtgcaggatgctacaaagaagcccgccgaggacggagttgcgatcttcataaatcctaacaatgaaaggacgccataccttcagcccgatgacacctatgtggtactgtggactaactggaaatccgaggtcaatcgggaagatgtggaggtgaagaagtttgtcggccctgggttccgcagatactcatttgagatgagcattacaatcccaggagttgaatttaaaaaggactcttacattggttttgatgtggccgtaatcgacgatggcaaatggtattcctggagtgacaccacaaacagccaaaagactaacaccatgaattacgggacgttgaaactcgagggagtgatggtcgctaccgcaaagtatggcacacccgtgatagatggtgaaatcgacgacatttggaacactaccgaggagatcgaaacaaagtctgttgccatggggtccctggagaaaaatgctactgccaaggtgagggtcttatgggatgaagagaacctgtacgtgctagcaattgttaaagacccggtgctcaataaggataactcaaatccttgggaacaggacagtgtcgagatcttcatagatgagaacaatcacaaaaccggctattacgaagacgatgacgcgcagtttcgtgtaaactatatgaatgagcagagcttcggaacgggcgcctcggctgcccggttcaagacagcagtgaaactgattgaagggggatacatcgttgaggctgccatcaagtggaagaccattaaaccatcccccaacactgtgatcggctttaatgtccaagtgaacgatgcaaatgaaaagggtcagcgagtagggattatatcttggagcgaccctacaaacaactcatggagagatcccagtaaattcggaaatcttaggttgatcaag

SEQ ID NO: 28463 - RNA, 3165 nt, synthetic construct; identical to SEQ ID NO: 28462
  misc_feature 1..3165: note = derived and/or modified sequence opt3 from anti-influenza_Chain
  source 1..3165: mol_type = other RNA

SEQ ID NO: 28464 - RNA, 3177 nt, synthetic construct
  misc_feature 1..3177: note = derived and/or modified sequence opt3 from anti-influenza_Chain
  source 1..3177: mol_type = other RNA
atgcaagtgagaaagaggcggggcctgctcgacgtcagcaccgccgttcttgtggggatcctggctggattcttgggtgtagtgttagcagcctccggcgtcctgtcttttgggaaagaggcgtcaagtaagggagatagctccctagaaacagtgctcgctctgtctttcgagggcactacggaaggtgttgtgccctttgggaaagacgtcgtgcttaccgcctcgcaggatgtagcagccgacggagagtactcactgaaggttgaaaaccgcacaagcccttgggatggcgtggagattgacttgactggcaaagtcaagagtggggctgattatctcctgtccttccaggtgtaccagtctagcgacgcaccacagctgtttaatgtggtcgcccgaaccgaggatgaaaagggagagcgttatgacgttatactcgataaagtggtagtgtccgaccactggaaggaaatcttagtcccgttctcacccacatttgagggtacccctgctaaatacagtctgattatcgtggccagcaagaacactaatttcaacttttatcttgataaagttcaagtgttggcgccaaaggagtctggccccaaggtcatttacgaaacatccttcgagaatggggtgggagactggcagcctagaggcgacgtaaacatcgaagcatcaagcgaggttgcccatagtggtaaatcttccctgtttataagcaataggcagaaggggtggcagggagctcaaatcaacctaaaaggcattctcaagaccggcaaaacgtatgccttcgaagcatgggtgtaccaaaattcggggcaggatcagactatcattatgaccatgcagcggaagtactcttccgacgcttcaacacagtatgagtggatcaaaagtgccactgtcccaagcggacagtgggtgcaactgtccggtacctacacaatacccgcgggcgtcaccgtggaggatcttacgctgtattttgaatctcagaaccctactttggagttctacgttgacgatgtgaagattgtagacacaaccagcgccgaaatcaagattgagatggaaccagagaaagagatcccggcactcaaggaagtcctgaaagattatttcaaggtgggggttgctttaccctcaaaagtgtttctgaatcctaaggacatcgagctcattactaagcacttcaacagtataacagccgaaaatgagatgaaaccagaatcccttctggctggaatcgagaacggcaagttgaaatttcgcttcgagaccgccgataagtacattcagtttgtcgaagagaatggtatggtgatcagagggcatacgctagtatggcacaaccagacccccgactggttctttaaagatgaaaacggcaatctgctcagcaaggaggcaatgacagagaggctgaaggaatatatacatactgtggttggacacttcaaaggcaaggtctacgcctgggacgtggtgaacgaggctgtcgaccctaatcaaccagatgggcttcggcgctctacctggtaccagattatgggacccgactatatcgaactggcgtttaaattcgcacgagaggccgatccggacgctaagttgttttacaacgattataatacattcgaacctagaaaaagggacatcatttacaacctcgttaaggatctgaaggagaaaggtttaatcgacggcattgggatgcagtgccacatatcactggccactgatatcaagcagattgaggaagcaatcaaaaagtttagtaccatccccggaattgagatacatatcacagaactagacatgagcgtgtatcgggattcctcttcgaattacccagaggcccctcgtaccgctctcattgaacaagcccacaaaatgatgcagctgttcgagatcttcaagaaatatagcaacgtgattactaatgtaacgttttggggccttaaggacgattactcctggcgcgcaacaagaaggaacgactggcccttgatcttcgacaaggatcatcaggcgaaactggcttactgggccatagtcgcaccagaggtgctgccccctctcccaaaggaatcacggatcagtgagggtgaagccgttgtggtcgggatgatggacgattcttatcttatgagcaaaccgattgagatcctggacgaagagggcaatgtgaaggctaccattcgagccgtttggaaagattccactatctacatatatggagaggtgcaggacaagaccaagaaacccgcagaagatggcgtagctatttttatcaaccctaataacgagcgcacaccatacttgcaacccgacgatacctatgccgtcctctggactaattggaagacagaagtgaacagagaggacgtgcaggtcaaaaagttcgttgggcctggatttaggcggtactcattcgagatgagcattacgatcccaggtgtggaatttaaaaaggattcttatataggcttcgacgcggccgtaatcgatgacgggaagtggtactcctggagtgacaccactaacagccagaaaacaaataccatgaactacggaacactgaagttagagggcattatggtggctactgcaaaatatggtacccccgtcatcgatggggaaattgacgagatctggaatacgaccgaagagatagagacaaaggccgtggctatgggctctctggataaaaacgccactgcaaaggttcgcgtgctatgggacgaaaattacctctatgtcctggcgattgtgaaggatccggttcttaacaaagacaattccaacccttgggagcaggattcagtggaaatctttatcgacgagaataaccacaagaccggatactatgaagatgacgatgcccaattcagagtcaattacatgaacgagcagacatttggcactgggggaagtccagctaggttcaaaaccgccgtaaagttgattgagggcggttatatcgtggaagcagctattaaatggaagacgataaaacccacacctaataccgttatcgggtttaacattcaggtgaatgacgccaacgagaagggacaacgtgtcggcatcattagctggtcggaccccactaacaattcctggcgggatccatctaagttcggtaacctgcgactcatcaaa

SEQ ID NO: 28465 - RNA, 3177 nt, synthetic construct; identical to SEQ ID NO: 28464
  misc_feature 1..3177: note = derived and/or modified sequence opt3 from anti-influenza_Chain
  source 1..3177: mol_type = other RNA

SEQ ID NO: 28466 - RNA, 318 nt, synthetic construct
  misc_feature 1..318: note = derived and/or modified sequence opt3 from anti-OX40_LightChain
  source 1..318: mol_type = other RNA
gagatcgtggtcacccagagccccgccacactgtccctctctcctggcgaaagagctactctttcatgcagggcaagtcaaagcgtttcctcttacctggcctggtatcagcagaagccagggcaggcgccgcggttgttaatttacgacgcttcgaaccgcgccacgggaatacccgcacgattctcaggtagcggcagtgggaccgattttacactgactatctcctctctagagcctgaagacttcgccgtgtattactgtcaacagcgtagcaattggccaacctttggacagggcacaaaagtagagattaag

SEQ ID NO: 28467 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatcctccaacctttggaggcggtacaaaagtggagatcaag

SEQ ID NO: 28468 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggacacacactacctccaacctttggccagggtactaaggtggaaatcaag

SEQ ID NO: 28469 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaaacggttaaacttctgatctactatacctctcggttgcgctcgggagtgccatcacgattcagcggtagtggctccgggacagattttactttaaccatttctagcctgcaaccggaggacttcgcaacatactattgtcagcagggacacaccctaccccctacttttggccagggtacaaaggtagaaatcaag

SEQ ID NO: 28470 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaaacggttaaacttctgatctactatacctctcggttgcgctcgggagtgccatcacgattcagcggtagtggctccgggaaggattacacattaactatttctagcctgcaaccggaggactttgcaacctatttctgtcagcagggacacacactaccccctacctttggccagggtactaaggtagaaatcaaa

SEQ ID NO: 28471 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggacacacactacctgcgacctttggccagggtactaaggtggaaatcaag

SEQ ID NO: 28472 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggacacacagcgcctccaacctttggccagggtactaaggtggaaatcaag

SEQ ID NO: 28473 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggagcgacactacctccaacctttggccagggtactaaggtggaaatcaag

SEQ ID NO: 28474 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggacacgcgctacctccaacatttggccagggtaccaaggtggaaatcaag

SEQ ID NO: 28475 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcaggcgcacacactacctccaacctttggacagggcactaaggtggaaatcaag

SEQ ID NO: 28476 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggacacacactagcgcctacctttggccagggtactaaggtggaaatcaag

SEQ ID NO: 28477 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcaggcgggacacacactacctccaacctttggccagggtactaaggtggaaatcaag

SEQ ID NO: 28478 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctaagttgcactcgggagttccgtcacggttcagcggtagtggctccgggaccgattacacattaactatttctagcctgcaacccgaggactttgccacctattactgtcagcagggatccgcgctaccttggacattcggccagggtaccaaggtggaaatcaaa

SEQ ID NO: 28479 - RNA, 321 nt, synthetic construct
  misc_feature 1..321: note = derived and/or modified sequence opt3 from anti-OX40_LightChain
  source 1..321: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcagttaaacttctgatctactatacgtctaagttgcactcgggagtgccatcacggttcagcggtagtggctcccgcaccgattacacattaactatttctagcctgcaaccggaggactttgccacctattactgtcagcaggggtccgcgctaccctggacattcggacagggcaccaaggtagaaatcaaa

SEQ ID NO: 28480 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacgcgcgacacctcgacatcaactgcgtaccttgagctgagcagtttgcgatccgaagataccgctgtgtattactgtgttttagccccgcgttggtatttctctgtgtggggccaaggtacactggtcaccgtgagctcc

SEQ ID NO: 28481 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacggtggacacctcgacatcaactgcgtaccttgagctgagcagtttgcgctccgaagataccgctgtttattactgtgtgttagccccgcgatggtatttctctgtctggggccaaggtacactggtgaccgtaagctcc

SEQ ID NO: 28482 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactcttacggtggacacctcgacatcaactgcgtacctggagttgagcagtttacgctccgaagataccgctgtttattactgtgtgctggccccgcgatggtatttctctgtctggggccaaggtaccctagtgacagtaagctcc

SEQ ID NO: 28483 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacgcctatatgagttgggtgagacaggcgcctggtcagggcctcgagtggatcggggatatgtacccagacaacggagatagctcctataatcagaagtttagggaacgggtcactattacgcgcgacacctctacatcgactgcttaccttgagctgagctcattgcgaagtgaagataccgccgtgtattactgtgttttagcaccgcgttggtatttctccgtgtggggccaaggtacactggtcaccgtgtctagc

SEQ ID NO: 28484 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagagagttatatgagctgggtgagacaggcccctggtcagggcctcgaatggatcggggacatgtacccagataacggagactcctcttataatcagaagtttagggagcgggtcactattacgcgcgatacctcgacatcaactgcgtaccttgaactgagcagtttgcgatccgaggacaccgctgtgtattactgtgttttagccccgcgttggtatttctctgtgtggggccaaggtacactggtcaccgtgagctcc

SEQ ID NO: 28485 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacgcggattcctcttataatcagaagtttagggaacgggtcactattacgcgcgacacctcgacatcaactgcttaccttgagctgagcagtttgcgatccgaagataccgccgtgtattactgtgttttagcaccgcgttggtatttctctgtgtggggacaaggcacactggtcaccgtgagctcc

SEQ ID NO: 28486 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacgcggatgcttcctataatcagaagtttagggaacgggtcactattacgcgcgacacctctacatcgactgcctaccttgagctgagctcattgcgaagtgaagataccgcagtgtattactgtgttttagccccgcgttggtatttctccgtgtggggacaaggcacactggtcaccgtgtctagc

SEQ ID NO: 28487 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagatgcgtcctataatcagaagtttagggaacgggtcactattacgcgcgacacctctacatcgactgcttaccttgagctgagctcattgcgaagtgaagataccgccgtgtattactgtgttttagcaccgcgttggtatttctccgtgtggggccaaggtacactggtcaccgtgtctagc

SEQ ID NO: 28488 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagactccggagattcttcgtataaccagaagtttagggaacgggtcactattacgcgcgacacctcaacaagcactgcgtaccttgagctgagttccttgcgatctgaagataccgctgtgtattactgtgttttagccccgcgttggtatttcagcgtgtggggccaaggtacactggtcaccgtgtcctca

SEQ ID NO: 28489 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggatcctcttcgtataatcagaagtttagggaacgggtcactattacgcgcgatacctcaacaagcactgcgtaccttgagctgagttccttgcgatctgaagacaccgctgtgtattactgtgttttagccccgcgttggtatttcagcgtgtggggccaaggtacactggtcaccgtgtcctca

SEQ ID NO: 28490 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacgcctatatgagttgggtgagacaggcgcctggtcagggcctcgagtggatcggggatatgtacccagacaacgctgatgccagctataatcagaagtttagggaacgggtcactattacgcgcgacacctccacatctactgcataccttgagctgtcgtcattgcgaagcgaagataccgccgtgtattactgtgttttagctccgcgttggtatttcagtgtgtggggacaaggcacactggtcaccgtgtcctct

SEQ ID NO: 28491 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacgcgcgacacctcgacatcaactgcgtaccttgagctgagcagtttgcgatccgaagataccgctgtgtattactgtgttttagccccgcgttggtatttctctgcatggggccaaggtacactggtgaccgtcagctcc

SEQ ID NO: 28492 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacgcgcgacacctcgacatcaactgcgtaccttgagctgagcagtttgcgatccgaagataccgctgtgtattactgtgttttagccccgcgttggtatttcgcagtgtggggccaaggtacactggtcaccgtgtctagc

SEQ ID NO: 28493 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacgcgcgacacctcgacatcaactgcgtaccttgagctgagcagtttgcgatccgaagataccgctgtgtattactgtgccttagcaccgcgttggtatttctctgtttggggccaaggtacactggtgaccgtcagctcc

SEQ ID NO: 28494 - RNA, 351 nt, synthetic construct
  misc_feature 1..351: note = derived and/or modified sequence opt3 from anti-OX40_HeavyChain
  source 1..351: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacgcgcgacacctcgacatcaactgcgtaccttgagctgagcagtttgcgatccgaagataccgctgtgtattactgtgttgccgcaccgcgttggtatttctctgtgtggggccaaggtacattagtcaccgtgagctcc

SEQ ID NO: 28495 - RNA, 354 nt, synthetic construct
  misc_feature 1..354: note = derived and/or modified sequence opt3 from anti-OX40_HeavyChain
  source 1..354: mol_type = other RNA
gaggtgcagctggtcgaaagcggcgggggactcgttcaacccggtggctcccttagactgtcttgcgccgcttcagggttcacctttagtagctactccatgaattgggtgaggcaggcacctggaaagggcttggagtgggtatcttatatctcgtcaagcagttccacaattgactacgccgattctgtgaaaggtcggttcactataagccgcgacaatgcgaagaactccttatatctgcagatgaactcactacgagatgaagacacggctgtctactattgtgcccgtgagagtgggtggtacctctttgattattggggacagggcaccctggtgacagttagctct

SEQ ID NO: 28496 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagacagcacccagggaaaggattggaatggattggctacatatcctataatggtatcacttaccataacccgtctttaaagtcgaggattacgatcaatcccgacaccagcaaaaaccaattttcactgcagctaaatagtgtgacacctgaggatactgctgtatattactgtgcacggtatcgctacgactacgatgggggacacgccatggactattggggccagggcaccctcgtgacagtctcctct

SEQ ID NO: 28497 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatggattggctacatatcctataatggtatcacttaccataacccgtctttaaaatcgaggattacgatcaatcgggacacctcaaagaaccagtttagcctgcaactaaatagtgtgacacccgaggatactgctgtatattactgtgcacgctatcgatacgactacgatgggggacacgccatggactattggggccagggcaccctcgtgacagtctcctct

SEQ ID NO: 28498 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggagactcattcagtagcggttattggaactggatcagaaaacacccaggcaaggggttggaatacatgggatatatttcctacaatggcataacttatcataacccgtctttaaaatcgaggatcacgattaatcgggatacctcaaagaaccagtacagcctgcaactaaatagtgtgacacccgaggacactgctgtatatttttgtgcacgctaccgatacgattatgacggtgggcacgccatggattactggggacagggcaccctcgtgacagtctcctct

SEQ ID NO: 28499 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggagactcattcagtagcggttattggaactggatcagaaaacacccaggcaaggggttggaatacattggatatatatcctacaatggcatcacttatcataacccgtctttaaaatcgaggattacgatcaatcgggatacctcaaagaaccagtacagcctgcaactaaatagtgtgacacccgaggacactgctgtatatttttgtgcacgctaccgatacgattatgacggtgggcacgccatggattactggggacagggcaccctcgtgacagtctcctct

SEQ ID NO: 28500 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggagactcattcagtagcggttattggaactggatcagaaaacacccaggcaaggggttggaatacattggatatatatcctacaatggcatcacttatcataacccgtctttaaaatcgaggattacgatcaatcgggatacctcaaagaaccagtttagcctgcaactaaatagtgtgacacccgaggacactgctgtatacttctgtgcacgctatcgatacgattacgacggtgggcacgccatggattattggggacagggcaccctcgtgacagtctcctct

SEQ ID NO: 28501 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggagactcattcagtagcggttattggaactggatcagaaaacacccaggcaaggggttggaatacattggatatatatcctacaatggcatcacttatcataacccgtctttaaaatcgaggattacgatcaatcgggatacctcaaagaaccagtacagcctgcaactaaatagtgtgacacccgaggacactgctgtatattactgtgcacgctaccgatatgattacgacggtgggcacgccatggattattggggacagggcaccctcgtgacagtctcctct

SEQ ID NO: 28502 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggagactcattcagtagcggttattggaactggatcagaaaacacccaggcaaggggttggaatacattggatatatatcctacaatggcatcacttatcataacccgtctttaaaatcgaggattacgatcaatcgggatacctcaaagaaccagtttagcctgcaactaaatagtgtgacacccgaggacactgctgtatactattgtgcacgctaccgatacgattatgacggtgggcacgccatggattactggggacagggcaccctcgtgacagtctcctct

SEQ ID NO: 28503 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatggtatcacttatcataacccgtctttaaaatcgaggattacgatcaatcccgacacctcaaagaaccagtacagcctgcaactaaatagtgtgacacctgaggatactgctgtatatttttgtgcacggtaccgctacgactatgatgggggacacgccatggactactggggccagggcaccctcgtgacagtctcctct

SEQ ID NO: 28504 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatggtatcacttatcataacccgtctttaaaatcgaggattacgatcaatcgggacacctcaaagaaccagtacagcctgcaactaaatagtgtgacacccgaggatactgctgtatatttttgtgcacgctaccgatacgactatgatgggggacacgccatggactactggggccagggcaccctcgtgacagtctcctct

SEQ ID NO: 28505 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatggtatcacttatcataacccgtctttaaaatcgaggattacgatcaatcgggacacctcaaagaaccagtacagcctgcaactaaatagtgtgacacccgaggatactgctgtatattactgtgcacgctaccgatatgactacgatgggggacacgccatggactattggggccagggcaccctcgtgacagtctcctct

SEQ ID NO: 28506 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatggtatcacttatcataacccgtctttaaaatcgaggattacgatcaatcccgacacctcaaagaaccagtacagcctgcaactaaatagtgtgacacctgaggatactgctgtatattactgtgcacggtaccgctatgactacgatgggggacacgccatggactattggggccagggcaccctcgtgacagtctcctct

SEQ ID NO: 28507 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatgctatcacttatcataacccgtctttaaaatcgaggattacgatcaatcgggacacctcaaagaaccagtacagcctgcaactaaatagtgtgacacccgaggatactgcagtatattactgtgcccgctacaaatatgactacgatgcgggtcacgctatggactattgggggcagggaaccctcgtgacagtctcctct

SEQ ID NO: 28508 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatgctatcacttatcataacccgtctttaaaatcgaggattacgatcaatcgggacacctcaaagaaccagtacagcctgcaactaaatagtgtgacacccgaggatactgcagtatattactgtgcccgctaccgatatgactacgatggtgggcacgcgatggactattggggacagggcaccctcgtgacagtctcctct

SEQ ID NO: 28509 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatggtatcacttatcataacccgtctttaaaatcgaggattacgatcaatcgggacacctcaaagaaccagtacagcctgcaactaaatagtgtgacacccgaggatactgctgtatattactgtgcacgctacaaatatgactacgatgggggacacgccatggactattggggccagggcaccctcgtgacagtctcctct

SEQ ID NO: 28510 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctactctggtatcacttatcataatccgtcgttaaaatcaaggattacgatcaaccgggacaccagcaagaatcagtacagtctgcaactaaactccgtgacacccgaggatactgctgtatattactgtgcacgctaccgatatgactacgatgggggacacgccatggactattggggccagggcaccctcgtgacagtctctagc

SEQ ID NO: 28511 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctactctggtatcacttatcataatccgtcgttaaaatcaaggattacgatcaaccgggacaccagcaagaatcagtacagtctgcaactaaactccgtgacacccgaggatactgctgtatattactgtgcacgctacaaatatgactacgatgggggacacgccatggactattggggccagggcaccctcgtgacagtctctagc

SEQ ID NO: 28512 - RNA, 363 nt, synthetic construct
  misc_feature 1..363: note = derived and/or modified sequence opt3 from anti-OX40_HeavyChain
  source 1..363: mol_type = other RNA
gaggtgcagctgcaagaaagcggcccctccctcgtcaagccttctcagaccctttcactgacatgcagtgttactggggacagcttcacgtccggatactggaactggatcagaaaatttccaggtaataggttggagtatatgggctacatttcttataacgccataacctaccacaatccgtcgttaaagtcacggatcagcattacacgcgataccagtaaaaaccattattacctgcagctaaattccgtgactacagaagacaccgctacttatttctgtgcacgataccgttacgattatgacgggggacacgccatggattactggggccagggtacactcgtaaccgtgtctagc

SEQ ID NO: 28513 - RNA, 363 nt, synthetic construct
  misc_feature 1..363: note = derived and/or modified sequence opt3 from anti-OX40_HeavyChain
  source 1..363: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatgctatcacttatcataacccgtctttaaaatcgaggattacgatcaatcgggacacctcaaagaaccagtacagcctgcaactaaatagtgtgacacccgaggatactgcagtatattactgtgcccgctacaaatatgactacgatggtgggcacgcgatggactattggggacagggcaccctcgtgacagtctcctct

SEQ ID NO: 28514 - RNA, 372 nt, synthetic construct
  misc_feature 1..372: note = derived and/or modified sequence opt3 from anti-OX40_HeavyChain
  source 1..372: mol_type = other RNA
gaggtgcagctggtcgaaagcggcgggggactcgttcaacccggtagatcccttaggctgtcttgcgccgcttcaggcttcacctttgacgattacgcaatgcactgggtgcggcaggcccctgggaagggattggagtgggtaagtggcatcagctggaactccggttctattgggtatgcggactcggtgaaaggacgcttcacaatatcacgagataatgctaagaacagcttatacctgcagatgaatagtctacgtgccgaagacactgcactctattactgtgccaaagatcagtccacggctgactattacttttattacggcatggatgtctggggccaagggaccacagtgactgtttctagc

SEQ ID NO: 28515 - RNA, 381 nt, synthetic construct
  misc_feature 1..381: note = derived and/or modified sequence opt3 from anti-OX40_LightChain
  source 1..381: mol_type = other RNA
atggagacccccgcccagctcctgttccttctgttgttatggctgcctgacacaactggcgaaatcgtgctaacgcaaagcccagggaccctctccctgtctccgggagagagagctattctttcatgcagggcaagtcagagcgtctcctcttcgtttctggcctggtaccagcagaagcccggtcaagcgcctcggttgctcatatatggcgctttctcacgcgccacagggatcccagatcgatttagcggaagtggctccggtactgacttcaccctgacaatttctcgtctggaacccgaggattttgcagtttactattgtcagcagtacgacagctccagaaccttcgggcagggaactaaagtggaaatcaag

SEQ ID NO: 28516 - RNA, 381 nt, synthetic construct
  misc_feature 1..381: note = derived and/or modified sequence opt3 from anti-OX40_LightChain
  source 1..381: mol_type = other RNA
atggaggcccccgctcagctcctgttccttctgttgttatggctgcctgacaccacaggcgaaatcgtgctaactcaaagcccagcaacgctctccctgtctccgggggagagagccaccctttcatgcagggcgagtcagggagtcagctcctacctggcttggtatcagcagaagcccggtcaagcccctcggttgctcatttacgatgcatctaaccgcgccacaggcataccagctcgattttcggggtcaggacccggcactgacttcaccctgacaatcagcagtctggaacctgaggattttgcagtttattactgtcagcagcgttccaattggcacccaaccttcggtcaggggactaaagtggaaattaag

SEQ ID NO: 28517 - RNA, 381 nt, synthetic construct
  misc_feature 1..381: note = derived and/or modified sequence opt3 from anti-OX40_LightChain
  source 1..381: mol_type = other RNA
atggaggcccccgctcagctcctgttccttctgttgttatggctgcctgacaccacaggcgaaatcgtgctaactcaaagcccagcaacgctctccctgtctccgggggagagagccaccctttcatgcagggcgagtcagagcgtctcctcttacctggcttggtatcagcagaagcccggacaagcccctcggttgctcatttacgatgcatcgaaccgcgccacaggtataccagctcgattttcaggcagcgggagtggaactgacttcaccctgacaatctcctctctggaacccgaggattttgcagtttattactgtcagcagcgtagcaattggcctattaccttcggccagggtactagactcgaaatcaaa

SEQ ID NO: 28518 - RNA, 387 nt, synthetic construct
  misc_feature 1..387: note = derived and/or modified sequence opt3 from anti-OX40_LightChain
  source 1..387: mol_type = other RNA
atggagacccccgcccagctcctgttccttctgttgttatggctgcctgacacaactggcgaaatcgtgctaacgcaaagcccagggaccctctccctgtctccgggagagagagctacactttcatgcagggcaagtcagagcgtctcctcttcgtacctggcctggtatcagcagaagcccggtcaagcgcctcggttgctcatttacggcgcttcaagccgcgccactgggataccagatcgatttagtggatccggctctggtaccgacttcacactgaccatcagccgtctggaacccgaggattttgcagtttattactgtcagcagtatgactcctcactcactttcgggggaggcacaaaagtggaaattaagagaacc

SEQ ID NO: 28519 - RNA, 390 nt, synthetic construct
  misc_feature 1..390: note = derived and/or modified sequence opt3 from anti-OX40_LightChain
  source 1..390: mol_type = other RNA
atggacatgagagtgctggcccagctccttggcctgttgttactgtgcttccccggggctaggtgtgatatccaaatgacccagagcccttcctctctatcagcaagtgtcggaaaccgggttacaattacttgccgcgccagccaggacatatcctcttggctcgcgtggtaccagcaaaagccagagaaagctccgaagtcgctgatctatgccgcatcaagccttcagagtggtgtgccctcccgattttctggcagcgggtccggaacggatttcaccctgacaatttcaagtttgcagcctgaagactttgccacttactattgtcagcaatacaatagctatccactcaccttcggccagggtacacgtctggagatcaaaaga

SEQ ID NO: 28520 - RNA, 408 nt, synthetic construct
  misc_feature 1..408: note = derived and/or modified sequence opt3 from anti-OX40_HeavyChain
  source 1..408: mol_type = other RNA
atggacaccctgtgcagcacactccttctgttgactatcccctcctgggtgttatctcagattacgctgaaggagtcaggccctaccctagtcaaaccaacacaaactctcaccctgagttgtacattcagcgggttttccctttctacctcgggagttggtgtgggctggataagacagccgcccgggaaggccctggaatggttggctctcatccactgggatgacgcagagaggtactcacctagcctgaaaagtcggctgactattacaaaggatacctccaaaaaccaggtagtgctcacgatgactaatatggacttagtcgataccgccacatattactgcgcgcatactcgcggagctttcgacatctggggccagggtaccatggtgacagtttctagc

SEQ ID NO: 28521 - RNA, 408 nt, synthetic construct
  misc_feature 1..408: note = derived and/or modified sequence opt3 from anti-OX40_HeavyChain
  source 1..408: mol_type = other RNA
atggacaccctgtgcagcacactccttctgttgactatcccctcctgggtgttatctcagattacgctgaaggagtcaggccctaccctagtcaaaccaacacaaactctcaccctgacatgtaccttcagtgggtttagcctttccacttctggagttggtgtgggctggataagacagccgcccgggaaggccctggaatggttggctctcatctactgggatgaccactcgccttattcaccaagcctgaaaagtaggctgacaattaccaaggatacgtccaaaaaccaggtagtgctcactatgaccaatatggaccccgtcgatacagcaacttactattgcgcccggacccgcggagcgttcgacatctggggccagggtacaatggtgaccgtttctagc

SEQ ID NO: 28522 - RNA, 420 nt, synthetic construct
  misc_feature 1..420: note = derived and/or modified sequence opt3 from anti-OX40_HeavyChain
  source 1..420: mol_type = other RNA
atggagtggggcccctgctgggtgttcctggtcgttatcctcgaaggggtgcagtgtggagtacaacttgtggagagcggtggcgggctggtccagcctggaggctccttgagattatcttgcgccgcttcaggttttaccttcagtagctactccatgaactgggtgaggcaggcaccagggaagggactggaatgggtttcttatatttcgtcaagcagttccacaatatactatgccgactctgtgaaaggccggtttactatcagccgcgataatgcgaagaactccctatacctccagatgaactcactgcgagacgaggatacggctgtctattactgtgcccgtggcgtgtatcacaatgggtggagtttctttgactactggggacaaggtacccttctgacagtaagctct

SEQ ID NO: 28523 - RNA, 423 nt, synthetic construct
  misc_feature 1..423: note = derived and/or modified sequence opt3 from anti-OX40_HeavyChain
  source 1..423: mol_type = other RNA
atggacaccctgtgcagcacactccttctgttgactatcccctcctgggtgttatctcagattacgctgaaggagtcaggccctaccctagtcaaaccaaagcaaacactcactctgacctgtacattcagtgggtttagcctttccacctctggaatgggtgttggctggataagacagccgcccgggaaagccctggaatggttggctgtgatctactgggatgaccaccagctctattcgccttcactcaagagcaggctgactattacaaaagataccagtaagaaccaggtagtgctgacgatgactaatatggacccagtcgataccgcaacatactattgcgcccatcggcgcggagcgttccaacactggggccagggtactttagtgaccgtttcctctgctagcacaaagggg

SEQ ID NO: 28524 - RNA, 462 nt, synthetic construct
  misc_feature 1..462: note = derived and/or modified sequence opt3 from anti-OX40_HeavyChain
  source 1..462: mol_type = other RNA
atgaccatgatcacacccagcctggtgccttcctctgacccactcgtcactgccgcttcagttcttgagttcgcactgttgattagattaacgataggccaggccgtggtaagtacccaaagcacagggggaggtctggtgcagccgggcaggtccctacggctctcttgcgcggcttcggggtttactctggatgactacggaatgcactgggtccgccaggcccccggcaagggtcttgaatgggtgtcagggatcagctggaatagtgattccattggatatgttgactctgtgaaaggccgattcaccatcagccgtgataatgcaaagaactccctgtacttgcagatgaactcactcagagtcgaggacacagccctgtattactgtgtgaaagatattagtggctggtatagctttgactactgggggcaaggaaccctggtaactgtttcttcc

SEQ ID NO: 28525 - RNA, 639 nt, synthetic construct
  misc_feature 1..639: note = derived and/or modified sequence opt3 from anti-OX40_LightChain
  source 1..639: mol_type = other RNA
gagatcgtggtcacccagagccccgccacactgtccctctctcctggcgaaagagctactctttcatgcagggcaagtcaaagcgtttcctcttacctggcctggtatcagcagaagccagggcaggcgccgcggttgttaatttacgacgcttcgaaccgcgccacgggaatacccgcacgattctcaggtagcggcagtgggaccgattttacactgactatctcctctctagagcctgaagacttcgccgtgtattactgtcaacagcgtagcaattggccaacctttggacagggcacaaaagtagagattaagagaaccgtggctgcaccctccgtcttcatctttcctccatcagatgaacagctcaaaagtggtactgccagcgtggtttgcctgcttaacaatttctatcccagggaggctaaggtgcaatggaaagtcgacaacgccctgcagtctggaaattcccaggagtcagtgacagaacaggatagcaaggacagtacctactctttgtccagcacgctcactctgtcgaaggcggattatgagaaacacaaggtatacgcatgtgaagttacccatcaagggctgtcttcccctgtgacaaaatcatttaaccggggcgagtgc

SEQ ID NO: 28526 - RNA, 1350 nt, synthetic construct
  misc_feature 1..1350: note = derived and/or modified sequence opt3 from anti-OX40_HeavyChain
  source 1..1350: mol_type = other RNA
gaggtgcagctggtcgaaagcggcgggggactcgttcaacccggtagatcccttaggctgtcttgcgccgcttcaggcttcacctttgacgattacgcaatgcactgggtgcggcaggcccctgggaagggattggagtgggtaagtggcatcagctggaactccggttctattgggtatgcggactcggtgaaaggacgcttcacaatatcacgagataatgctaagaacagcttatacctgcagatgaatagtctacgtgccgaagacactgcactctattactgtgccaaagatcagtccacggctgactattacttttattacggcatggatgtctggggccaagggaccacagtgactgtttctagcgcatccaccaagggaccatcagtgttcccgctggccccctgcagtagaagcacatctgagtccaccgctgcccttggttgtctggtcaaagactactttcctgaaccagtgactgtatcatggaacagcggcgcgttgacaagtggggttcataccttccccgcagtgctccagtcttccggactgtatagcctgtcgtctgtcgtgacggtgccttcctcaaattttggcactcagacctacacatgcaacgtcgatcacaagccaagtaatactaaggttgacaaaaccgtggagaggaagtgttgcgtagagtgtcccccttgcccagccccgcccgtggctggtcctagcgtcttcctctttccacccaaacctaaggatacattaatgatctcccggaccccagaagtgacgtgtgttgtggtcgacgtgtctcatgaggatcccgaagtacagttcaactggtatgttgacggggtggaggtccacaatgccaaaactaagccgcgcgaggaacaatttaacagcacattcagagtggtctcagtgctgaccgttgtgcatcaggactggcttaatggaaaggagtacaaatgcaaggtaagtaacaaaggcttgcctgcacccattgaaaagactatctccaaaacaaagggccagccaagggagcctcaggtctataccctgcccccaagccgggaagagatgacgaaaaatcaagtgtctctaacctgtctcgttaaggggttttacccctcagatattgctgtggagtgggaaagtaacggacagcctgagaataactataagacaactccaccgatgctggacagcgatggttccttcttcctttactctaaactgaccgtcgacaagtcgcgctggcagcaaggcaacgtgtttagctgctccgtaatgcacgaagccttgcacaatcattacacacagaaatcactcagtctgtctcccgggaag

SEQ ID NO: 28527 - RNA, 21 nt, synthetic construct
  misc_feature 1..21: note = derived and/or modified sequence opt3 from anti-HIV_VRC01_VRC02_NIH45-46_LightChain_CDR
  source 1..21: mol_type = other RNA
tgccagcaatacgagttcttt

SEQ ID NO: 28528 - RNA, 42 nt, synthetic construct
  misc_feature 1..42: note = derived and/or modified sequence opt3 from anti-HIV_VRC01_HeavyChain_CDR
  source 1..42: mol_type = other RNA
accagaggcaagaactgcgactacaattgggatttcgagcac

SEQ ID NO: 28529 - RNA, 21 nt, synthetic construct
  misc_feature 1..21: note = derived and/or modified sequence opt3 from anti-HIV_3BNC60_LightChain_CDR
  source 1..21: mol_type = other RNA
tgccaggtgtacgagttcatc

SEQ ID NO: 28530 - RNA, 36 nt, synthetic construct
  misc_feature 1..36: note = derived and/or modified sequence opt3 from anti-HIV_3BNC60_HeavyChain_CDR
  source 1..36: mol_type = other RNA
gccagacagaggagcgacttctgggattttgacgtg

SEQ ID NO: 28531 - RNA, 36 nt, synthetic construct
  misc_feature 1..36: note = derived and/or modified sequence opt3 from anti-HIV_5H/I1-BMV-D5_HeavyChain_CDR
  source 1..36: mol_type = other RNA
gccagagacaaccccaccctgctcggcagcgattac

SEQ ID NO: 28532 - RNA, 33 nt, synthetic construct
  misc_feature 1..33: note = derived and/or modified sequence opt3 from anti-HIV_8ANC195_LightChain_CDR
  source 1..33: mol_type = other RNA
tgccagcaatacgacacctatcccggcacattc

SEQ ID NO: 28533 - RNA, 33 nt, synthetic construct
  misc_feature 1..33: note = derived and/or modified sequence opt3 from anti-HIV_CH01_CH02_CH03_LightChain_CDR
  source 1..33: mol_type = other RNA
tgccagcaatacggcgggagcccctataccttc

SEQ ID NO: 28534 - RNA, 78 nt, synthetic construct
  misc_feature 1..78: note = derived and/or modified sequence opt3 from anti-HIV_CH01_HeavyChain_CDR
  source 1..78: mol_type = other RNA
gccagaggcaccgactacacaatcgatgacgctgggattcactatcagggaagcggtactttctggtactttgatctg

SEQ ID NO: 28535 - RNA, 78 nt, synthetic construct
  misc_feature 1..78: note = derived and/or modified sequence opt3 from anti-HIV_CH02_HeavyChain_CDR
  source 1..78: mol_type = other RNA
gccagaggcaccgactacacaatcgatgaccaggggaggttctatcaaggaagcggtactttttggtacttcgatttt

SEQ ID NO: 28536 - RNA, 78 nt, synthetic construct
  misc_feature 1..78: note = derived and/or modified sequence opt3 from anti-HIV_CH03_HeavyChain_CDR
  source 1..78: mol_type = other RNA
gccagaggcaccgactacacaatcgatgaccaggggattttctataagggaagcggtactttttggtacttcgatctg

SEQ ID NO: 28537 - RNA, 33 nt, synthetic construct
  misc_feature 1..33: note = derived and/or modified sequence opt3 from anti-HIV_CH04_LightChain_CDR
  source 1..33: mol_type = other RNA
tgccagcaatacggcagaagcccctataccttc

SEQ ID NO: 28538 - RNA, 78 nt, synthetic construct
  misc_feature 1..78: note = derived and/or modified sequence opt3 from anti-HIV_CH04_HeavyChain_CDR
  source 1..78: mol_type = other RNA
gccagaggcaccgactacacaatcgatgaccaggggattaggtatcaaggaagcggtactttctggtactttgatgtg

SEQ ID NO: 28539 - RNA, 54 nt, synthetic construct
  misc_feature 1..54: note = derived and/or modified sequence opt3 from anti-HIV_NIH45-46_HeavyChain_CDR
  source 1..54: mol_type = other RNA
accagaggcaagtactgcacagccagggactattacaactgggatttcgagcac

SEQ ID NO: 28540 - RNA, 90 nt, synthetic construct
  misc_feature 1..90: note = derived and/or modified sequence opt3 from anti-HIV_PG16_HeavyChain_CDR
  source 1..90: mol_type = other RNA
gccagagaggctggcgggcccatctggcacgacgatgtgaagtactatgacttcaacgatggatactataattaccattatatggacgtc

SEQ ID NO: 28541 - RNA, 36 nt, synthetic construct
  misc_feature 1..36: note = derived and/or modified sequence opt3 from anti-HIV_PGT122_LightChain_CDR
  source 1..36: mol_type = other RNA
cacatctgggacagcagaaggcccaccaactgggtg

SEQ ID NO: 28542 - RNA, 72 nt, synthetic construct
  misc_feature 1..72: note = derived and/or modified sequence opt3 from anti-HIV_PGT122_HeavyChain_CDR
  source 1..72: mol_type = other RNA
accaagcacggcagaaggatctacggggtggtcgccttcaaagagtggtttacatatttctacatggacgtt

SEQ ID NO: 28543 - RNA, 36 nt, synthetic construct
  misc_feature 1..36: note = derived and/or modified sequence opt3 from anti-HIV_PGT123_LightChain_CDR
  source 1..36: mol_type = other RNA
cacatctacgacgccagaggcgggaccaactgggtg

SEQ ID NO: 28544 - RNA, 72 nt, synthetic construct
  misc_feature 1..72: note = derived and/or modified sequence opt3 from anti-HIV_PGT123_HeavyChain_CDR
  source 1..72: mol_type = other RNA
gccctgcacggcaagagaatctacgggattgtggctctcggagagcttttcacctatttttacatggacgtc

SEQ ID NO: 28545 - RNA, 30 nt, synthetic construct; identical to SEQ ID NO: 13261
  misc_feature 1..30: note = derived and/or modified sequence opt3 from anti-HIV_PGT125_PGT128_LightChain_CDR
  source 1..30: mol_type = other RNA

SEQ ID NO: 28546 - RNA, 57 nt, synthetic construct
  misc_feature 1..57: note = derived and/or modified sequence opt3 from anti-HIV_PGT125_HeavyChain_CDR
  source 1..57: mol_type = other RNA
ttcgacggcgaggtgctggtctacaaccactggcccaagcctgcctgggttgatctc

SEQ ID NO: 28547 - RNA, 30 nt, synthetic construct; identical to SEQ ID NO: 13263
  misc_feature 1..30: note = derived and/or modified sequence opt3 from anti-HIV_PGT126_PGT127_LightChain_CDR
  source 1..30: mol_type = other RNA

SEQ ID NO: 28548 - RNA, 57 nt, synthetic construct
  misc_feature 1..57: note = derived and/or modified sequence opt3 from anti-HIV_PGT126_HeavyChain_CDR
  source 1..57: mol_type = other RNA
ttcgacggcgaggtgctggtctaccacgattggcccaagcctgcctgggttgacctc

SEQ ID NO: 28549 - RNA, 57 nt, synthetic construct
  misc_feature 1..57: note = derived and/or modified sequence opt3 from anti-HIV_PGT127_HeavyChain_CDR
  source 1..57: mol_type = other RNA
ttcggcggggaggtgctggtctacagagactggcccaagcctgcctgggttgatctc

SEQ ID NO: 28550 - RNA, 57 nt, synthetic construct
  misc_feature 1..57: note = derived and/or modified sequence opt3 from anti-HIV_PGT128_HeavyChain_CDR
  source 1..57: mol_type = other RNA
ttcggcggggaggtgctgagatacaccgactggcccaagcctgcctgggtcgatctc

SEQ ID NO: 28551 - RNA, 30 nt, synthetic construct
  misc_feature 1..30: note = derived and/or modified sequence opt3 from anti-HIV_PGT130_LightChain_CDR
  source 1..30: mol_type = other RNA
agctccctgttcggcagatgggacgtggtc

SEQ ID NO: 28552 - RNA, 57 nt, synthetic construct
  misc_feature 1..57: note = derived and/or modified sequence opt3 from anti-HIV_PGT130_HeavyChain_CDR
  source 1..57: mol_type = other RNA
agcggcggggacatcctgtactattacgagtggcagaagccccactggttctcccct

SEQ ID NO: 28553 - RNA, 30 nt, synthetic construct
  misc_feature 1..30: note = derived and/or modified sequence opt3 from anti-HIV_PGT131_LightChain_CDR
  source 1..30: mol_type = other RNA
agctccctgtctggcagatgggacatcgtg

SEQ ID NO: 28554 - RNA, 57 nt, synthetic construct
  misc_feature 1..57: note = derived and/or modified sequence opt3 from anti-HIV_PGT131_HeavyChain_CDR
  source 1..57: mol_type = other RNA
agcggcggggacatcctgtactatattgagtggcagaagccccactggttctaccct

SEQ ID NO: 28555 - RNA, 27 nt, synthetic construct
  misc_feature 1..27: note = derived and/or modified sequence opt3 from anti-HIV_PGT135_PGT136_PGT137_LightChain_CDR
  source 1..27: mol_type = other RNA
cagcaatacgaggaatggcccagaacc

SEQ ID NO: 28556 - RNA, 54 nt, synthetic construct
  misc_feature 1..54: note = derived and/or modified sequence opt3 from anti-HIV_PGT135_HeavyChain_CDR
  source 1..54: mol_type = other RNA
cacagacatcacgacgtgttcatgctggtccccatcgccggctggtttgatgtt

SEQ ID NO: 28557 - RNA, 54 nt, synthetic construct
  misc_feature 1..54: note = derived and/or modified sequence opt3 from anti-HIV_PGT136_HeavyChain_CDR
  source 1..54: mol_type = other RNA
cacaagtaccatgacatcttcagagtggtccccgttgccggctggtttgatcct

SEQ ID NO: 28558 - RNA, 54 nt, synthetic construct
  misc_feature 1..54: note = derived and/or modified sequence opt3 from anti-HIV_PGT137_HeavyChain_CDR
  source 1..54: mol_type = other RNA
cacaagtaccatgacatcgtgatggtcgttcccattgccggctggttcgatcct

SEQ ID NO: 28559 - RNA, 27 nt, synthetic construct
  misc_feature 1..27: note = derived and/or modified sequence opt3 from anti-HIV_PGT141_PGT142_PGT143_PGT144_LightChain_CDR
  source 1..27: mol_type = other RNA
atgcagggcctgaacagaccctggacc

SEQ ID NO: 28560 - RNA, 96 nt, synthetic construct
  misc_feature 1..96: note = derived and/or modified sequence opt3 from anti-HIV_PGT141_HeavyChain_CDR
  source 1..96: mol_type = other RNA
ggcagcaagcacagactgagggactacgtgctctatgatgactacgggcttatcaactatcaggaatggaatgattacctggagttcttggacgtc

SEQ ID NO: 28561 - RNA, 96 nt, synthetic construct
  misc_feature 1..96: note = derived and/or modified sequence opt3 from anti-HIV_PGT144_HeavyChain_CDR
  source 1..96: mol_type = other RNA
ggcagcaagcacagactgagggactacgtgctctatgatgactacgggcttatcaaccagcaagaatggaatgattatctggagttcttggacgtc

SEQ ID NO: 28562 - RNA, 27 nt, synthetic construct
  misc_feature 1..27: note = derived and/or modified sequence opt3 from anti-HIV_PGT145_LightChain_CDR
  source 1..27: mol_type = other RNA
atgcagggcctgcacagcccctggacc

SEQ ID NO: 28563 - RNA, 93 nt, synthetic construct
  misc_feature 1..93: note = derived and/or modified sequence opt3 from anti-HIV_PGT145_HeavyChain_CDR
  source 1..93: mol_type = other RNA
ggcagcaagcacagactgagggactacttcctctataacgagtacgggcccaattatgaagagtggggagattaccttgccaccctggacgtg

SEQ ID NO: 28564 - RNA, 21 nt, synthetic construct
  misc_feature 1..21: note = derived and/or modified sequence opt3 from anti-HIV_VRC-CH30_VRC-CH31_VRC-CH32_VRC-CH33_VRC-CH34_Light Chain _CDR
  source 1..21: mol_type = other RNA
tgccagcaatacgagaccttc

SEQ ID NO: 28565 - RNA, 45 nt, synthetic construct
  misc_feature 1..45: note = derived and/or modified sequence opt3 from anti-HIV_VRC-CH30_VRC-CH31_VRC-CH32_VRC-CH34_HeavyChain_CDR
  source 1..45: mol_type = other RNA
gccagagctcagaagaggggccggagcgagtgggcatacgcccac

SEQ ID NO: 28566 - RNA, 45 nt, synthetic construct
  misc_feature 1..45: note = derived and/or modified sequence opt3 from anti-HIV_VRC-CH33_HeavyChain_CDR
  source 1..45: mol_type = other RNA
gccagagctcagaagagggcacggagcgagtgggcctacgcgcac

SEQ ID NO: 28567 - RNA, 21 nt, synthetic construct
  misc_feature 1..21: note = derived and/or modified sequence opt3 from anti-HIV_VRC-PG04_LightChain_CDR
  source 1..21: mol_type = other RNA
tgccagcaactggagttcttt

SEQ ID NO: 28568 - RNA, 48 nt, synthetic construct
  misc_feature 1..48: note = derived and/or modified sequence opt3 from anti-HIV_VRC-PG04_HeavyChain_CDR
  source 1..48: mol_type = other RNA
gccagacagaagttctacaccggcgggcaaggatggtattttgacctg

SEQ ID NO: 28569 - RNA, 21 nt, synthetic construct
  misc_feature 1..21: note = derived and/or modified sequence opt3 from anti-HIV_VRC-PG04b_LightChain_CDR
  source 1..21: mol_type = other RNA
tgccagcaagtggagttcttt

SEQ ID NO: 28570 - RNA, 48 nt, synthetic construct
  misc_feature 1..48: note = derived and/or modified sequence opt3 from anti-HIV_VRC-PG04b_HeavyChain_CDR
  source 1..48: mol_type = other RNA
gccagacagaagttcgagaggggcgggcaaggatggtactttgacctg

SEQ ID NO: 28571 - RNA, 21 nt, synthetic construct
  misc_feature 1..21: note = derived and/or modified sequence opt3 from anti-HIV_VRC03_LightChain_CDR
  source 1..21: mol_type = other RNA
tgccagcaattcgagtttttc

SEQ ID NO: 28572 - RNA, 48 nt, synthetic construct
  misc_feature 1..48: note = derived and/or modified sequence opt3 from anti-HIV_VRC03_HeavyChain_CDR
  source 1..48: mol_type = other RNA
gtgagaaggggcagctgcgactactgtggggatttcccctggcagtat

SEQ ID NO: 28573 - RNA, 21 nt, synthetic construct
  misc_feature 1..21: note = derived and/or modified sequence opt3 from anti-HIV_1TJG_P-Chain
  source 1..21: mol_type = other RNA
gagctggacaagtgggccagc

SEQ ID NO: 28574 - RNA, 69 nt, synthetic construct
  misc_feature 1..69: note = derived and/or modified sequence opt3 from anti-HIV_2B1H_P-Chain
  source 1..69: mol_type = other RNA
aacaataccaagaaaagcatcaagattagacccaggcaggccttctacgctacaaacggcataatcggg

SEQ ID NO: 28575 - RNA, 69 nt, synthetic construct
  misc_feature 1..69: note = derived and/or modified sequence opt3 from anti-HIV_2B1A_P-Chain
  source 1..69: mol_type = other RNA
aacaataccagaaagagcatccacctgggccccgggagggccttctacgctacaggagacattataggt

SEQ ID NO: 28576 - RNA, 57 nt, synthetic construct
  misc_feature 1..57: note = derived and/or modified sequence opt3 from anti-HIV_2B0S_P-Chain
  source 1..57: mol_type = other RNA
aagagaaaaaggatccacattggccccgggcgggccttctacaccacaaagaacgct

SEQ ID NO: 28577 - RNA, 69 nt, synthetic construct
  misc_feature 1..69: note = derived and/or modified sequence opt3 from anti-HIV_3UJJ_P-Chain
  source 1..69: mol_type = other RNA
aacaataccagaaagagcatcaggattggccccgggcaggccttctacgctacaggagacataatcggt

SEQ ID NO: 28578 - RNA, 69 nt, synthetic construct
  misc_feature 1..69: note = derived and/or modified sequence opt3 from anti-HIV_3UJI_P-Chain
  source 1..69: mol_type = other RNA
tacaacaagagaaaaaggatccacattggccccgggcgggccttctataccacaaagaatataatcgga

SEQ ID NO: 28579 - RNA, 75 nt, synthetic construct
  misc_feature 1..75: note = derived and/or modified sequence opt3 from anti-HIV_3MLZ_P-Chain
  source 1..75: mol_type = other RNA
agcaacaataccagaaagggcatccacattgggcccggaagggccttctacgctacaggtcagataactggcgac

SEQ ID NO: 28580 - RNA, 60 nt, synthetic construct
  misc_feature 1..60: note = derived and/or modified sequence opt3 from anti-HIV_3MLV_Q-Chain
  source 1..60: mol_type = other RNA
aacaataccagaaagaggatccgggtgggccccgggcagacagtctacgccactaacgct

SEQ ID NO: 28581 - RNA, 69 nt, synthetic construct
  misc_feature 1..69: note = derived and/or modified sequence opt3 from anti-HIV_3MLU_P-Chain
  source 1..69: mol_type = other RNA
aacaataccagaaagagcatcaggattggccccgggcaggccttctacgctacaggaggtataatcggc

SEQ ID NO: 28582 - RNA, 60 nt, synthetic construct
  misc_feature 1..60: note = derived and/or modified sequence opt3 from anti-HIV_3MLR_P-Chain
  source 1..60: mol_type = other RNA
aacaataccaagaaaggcatcgccattgggcccggaagaacactgtacgctagggagaag

SEQ ID NO: 28583 - RNA, 48 nt, synthetic construct
  misc_feature 1..48: note = derived and/or modified sequence opt3 from anti-HIV_4XCF_P-Chain
  source 1..48: mol_type = other RNA
aactggtgggacatcaccaattggctgtggtacattaagaaaaagaaa

SEQ ID NO: 28584 - RNA, 45 nt, synthetic construct
  misc_feature 1..45: note = derived and/or modified sequence opt3 from anti-HIV_4XBE_P-Chain
  source 1..45: mol_type = other RNA
aactggttcgacatcaccaattggctgtggtacattaagaaaaag

SEQ ID NO: 28585 - RNA, 48 nt, synthetic construct
  misc_feature 1..48: note = derived and/or modified sequence opt3 from anti-HIV_4XAW_P-Chain
  source 1..48: mol_type = other RNA
aactggttcgacatcaccaattggctgtggtacattaagaaaaagaaa

SEQ ID NO: 28586 - RNA, 45 nt, synthetic construct
  misc_feature 1..45: note = derived and/or modified sequence opt3 from anti-HIV_2QSC_P-Chain
  source 1..45: mol_type = other RNA
agaaagaggatccacattggccccgggcgggccttctacaccaca

SEQ ID NO: 28587 - RNA, 60 nt, synthetic construct
  misc_feature 1..60: note = derived and/or modified sequence opt3 from anti-HIV_3MLS_S-Chain
  source 1..60: mol_type = other RNA
gcctgccaggctttctacgcaagctcccccagaaagtctatccacattggcgcctgtgcg

SEQ ID NO: 28588 - RNA, 42 nt, synthetic construct
  misc_feature 1..42: note = derived and/or modified sequence opt3 from anti-HIV_3GO1_P-Chain
  source 1..42: mol_type = other RNA
agaaagaggatccacattggccccgggcgggccttctacacc

SEQ ID NO: 28589 - RNA, 42 nt, synthetic construct
  misc_feature 1..42: note = derived and/or modified sequence opt3 from anti-HIV_4M1D_Q-Chain
  source 1..42: mol_type = other RNA
tgcagaatccacattggccccgggagggccttctacacctgt

SEQ ID NO: 28590 - RNA, 39 nt, synthetic construct
  misc_feature 1..39: note = derived and/or modified sequence opt3 from anti-HIV_3C2A_Q-Chain
  source 1..39: mol_type = other RNA
aagagcatccacctgggccccgggagagccttctacgct

SEQ ID NO: 28591 - RNA, 12 nt, synthetic construct
  misc_feature 1..12: note = derived and/or modified sequence opt3 from anti-HIV_CDR
  source 1..12: mol_type = other RNA
cagagcaagacc

SEQ ID NO: 28592 - RNA, 12 nt, synthetic construct
  misc_feature 1..12: note = derived and/or modified sequence opt3 from anti-HIV_CDR
  source 1..12: mol_type = other RNA
gacctgatcgat

SEQ ID NO: 28593 - RNA, 15 nt, synthetic construct
  misc_feature 1..15: note = derived and/or modified sequence opt3 from anti-HIV_CDR
  source 1..15: mol_type = other RNA
gaccactactggagc

SEQ ID NO: 28594 - RNA, 15 nt, synthetic construct
  misc_feature 1..15: note = derived and/or modified sequence opt3 from anti-HIV_CDR
  source 1..15: mol_type = other RNA
ggcagattctggagc

SEQ ID NO: 28595 - RNA, 15 nt, synthetic construct
  misc_feature 1..15: note = derived and/or modified sequence opt3 from anti-HIV_CDR
  source 1..15: mol_type = other RNA
aactactattggacc

SEQ ID NO: 28596 - RNA, 15 nt, synthetic construct
  misc_feature 1..15: note = derived and/or modified sequence opt3 from anti-HIV_CDR
  source 1..15: mol_type = other RNA
gacgcctactggagc

SEQ ID NO: 28597 - RNA, 15 nt, synthetic construct
  misc_feature 1..15: note = derived and/or modified sequence opt3 from anti-HIV_CDR
  source 1..15: mol_type = other RNA
gacagctactggtcc

SEQ ID NO: 28598 - RNA, 15 nt, synthetic construct
  misc_feature 1..15: note = derived and/or modified sequence opt3 from anti-HIV_CDR
  source 1..15: mol_type = other RNA
gacaactactggagc

SEQ ID NO: 28599 - RNA, 15 nt, synthetic construct
  misc_feature 1..15: note = derived and/or modified sequence opt3 from anti-HIV_CDR
  source 1..15: mol_type = other RNA
aacagctactggacc

SEQ ID NO: 28600 - RNA, 15 nt, synthetic construct
  misc_feature 1..15: note = derived and/or modified sequence opt3 from anti-HIV_CDR
  source 1..15: mol_type = other RNA
agctactattggtcc

SEQ ID NO: 28601 - RNA, 15 nt, synthetic construct
  misc_feature 1..15: note = derived and/or modified sequence opt3 from anti-HIV_CDR
  source 1..15: mol_type = other RNA
agcttcggcatgcac

SEQ ID NO: 28602 - RNA, 15 nt, synthetic construct
  misc_feature 1..15: note = derived and/or modified sequence opt3 from anti-HIV_CDR
  source 1..15: mol_type = other RNA
gccgctttccagtgg

SEQ ID NO: 28603 - RNA, 15 nt, synthetic construct
  misc_feature 1..15: note = derived and/or modified sequence opt3 from anti-HIV_CDR
  source 1..15: mol_type = other RNA
cagcaactgagaacc

SEQ ID NO: 28604 - RNA, 15 nt, synthetic construct
  misc_feature 1..15: note = derived and/or modified sequence opt3 from anti-HIV_CDR
  source 1..15: mol_type = other RNA
cagcaatacgacagc

SEQ ID NO: 28605 - RNA, 15 nt, synthetic construct
  misc_feature 1..15: note = derived and/or modified sequence opt3 from anti-HIV_CDR
  source 1..15: mol_type = other RNA
cagcaactggccacc

SEQ ID NO: 28606 - RNA, 15 nt, synthetic construct
  misc_feature 1..15: note = derived and/or modified sequence opt3 from anti-HIV_CDR
  source 1..15: mol_type = other RNA
gagagcttccagtgg

SEQ ID NO: 28607 - RNA, 15 nt, synthetic construct
  misc_feature 1..15: note = derived and/or modified sequence opt3 from anti-HIV_CDR
  source 1..15: mol_type = other RNA
gaagtgtacgagttc

SEQ ID NO: 28608 - RNA, 15 nt, synthetic construct
  misc_feature 1..15: note = derived and/or modified sequence opt3 from anti-HIV_CDR
  source 1..15: mol_type = other RNA
gccagcctggagttc

SEQ ID NO: 28609 - RNA, 15 nt, synthetic construct
  misc_feature 1..15: note = derived and/or modified sequence opt3 from anti-HIV_CDR
  source 1..15: mol_type = other RNA
agcgtgtacgagttc

SEQ ID NO: 28610 - RNA, 15 nt, synthetic construct
  misc_feature 1..15: note = derived and/or modified sequence opt3 from anti-HIV_CDR
  source 1..15: mol_type = other RNA
gccgctctggagttc

SEQ ID NO: 28611 - RNA, 15 nt, synthetic construct
  misc_feature 1..15: note = derived and/or modified sequence opt3 from anti-HIV_CDR
  source 1..15: mol_type = other RNA
gccgtggtcgagttc

SEQ ID NO: 28612 - RNA, 15 nt, synthetic construct
  misc_feature 1..15: note = derived and/or modified sequence opt3 from anti-HIV_CDR
  source 1..15: mol_type = other RNA
cagctgttcgagttt

SEQ ID NO: 28613 - RNA, 15 nt, synthetic construct
  misc_feature 1..15: note = derived and/or modified sequence opt3 from anti-HIV_CDR
  source 1..15: mol_type = other RNA
gccgtgttccagtgg

SEQ ID NO: 28614 - RNA, 15 nt, synthetic construct
  misc_feature 1..15: note = derived and/or modified sequence opt3 from anti-HIV_CDR
  source 1..15: mol_type = other RNA
gccgtgctggagttc

SEQ ID NO: 28615 - RNA, 15 nt, synthetic construct
  misc_feature 1..15: note = derived and/or modified sequence opt3 from anti-HIV_CDR
  source 1..15: mol_type = other RNA
aacggcttcgacgtg

SEQ ID NO: 28616 - RNA, 15 nt, synthetic construct
  misc_feature 1..15: note = derived and/or modified sequence opt3 from anti-HIV_CDR
  source 1..15: mol_type = other RNA
cagcaatacgagttc

SEQ ID NO: 28617 - RNA, 15 nt, synthetic construct
  misc_feature 1..15: note = derived and/or modified sequence opt3 from anti-HIV_CDR
  source 1..15: mol_type = other RNA
cagcactacgagttc

SEQ ID NO: 28618 - RNA, 15 nt, synthetic construct
  misc_feature 1..15: note = derived and/or modified sequence opt3 from anti-HIV_CDR
  source 1..15: mol_type = other RNA
caggtgtacgaggtc

SEQ ID NO: 28619 - RNA, 15 nt, synthetic construct
  misc_feature 1..15: note = derived and/or modified sequence opt3 from anti-HIV_CDR
  source 1..15: mol_type = other RNA
caggtgtacgagttc

SEQ ID NO: 28620 - RNA, 15 nt, synthetic construct
  misc_feature 1..15: note = derived and/or modified sequence opt3 from anti-HIV_CDR
  source 1..15: mol_type = other RNA
ttcagcaaggagtcc

SEQ ID NO: 28621 - RNA, 15 nt, synthetic construct
  misc_feature 1..15: note = derived and/or modified sequence opt3 from anti-HIV_CDR
  source 1..15: mol_type = other RNA
ctgaagctcagctcc

SEQ ID NO: 28622 - RNA, 15 nt, synthetic construct
  misc_feature 1..15: note = derived and/or modified sequence opt3 from anti-HIV_CDR
  source 1..15: mol_type = other RNA
tacaaggtgagctcc

SEQ ID NO: 28623 - RNA, 15 nt, synthetic construct
  misc_feature 1..15: note = derived and/or modified sequence opt3 from anti-HIV_CDR
  source 1..15: mol_type = other RNA
ccccctcaggagagc

SEQ ID NO: 28624 - RNA, 15 nt, synthetic construct
  misc_feature 1..15: note = derived and/or modified sequence opt3 from anti-HIV_CDR
  source 1..15: mol_type = other RNA
accgccagagactac

SEQ ID NO: 28625 - RNA, 15 nt, synthetic construct
  misc_feature 1..15: note = derived and/or modified sequence opt3 from anti-HIV_CDR
  source 1..15: mol_type = other RNA
atgcagagcatccaa

SEQ ID NO: 28626 - RNA, 15 nt, synthetic construct
  misc_feature 1..15: note = derived and/or modified sequence opt3 from anti-HIV_CDR
  source 1..15: mol_type = other RNA
caccagctggacacc

SEQ ID NO: 28627 - RNA, 15 nt, synthetic construct
  misc_feature 1..15: note = derived and/or modified sequence opt3 from anti-HIV_CDR
  source 1..15: mol_type = other RNA
caccagctggacagc

SEQ ID NO: 28628 - RNA, 15 nt, synthetic construct
  misc_feature 1..15: note = derived and/or modified sequence opt3 from anti-HIV_CDR
  source 1..15: mol_type = other RNA
cagcaactgggcacc

SEQ ID NO: 28629 - RNA, 15 nt, synthetic construct
  misc_feature 1..15: note = derived and/or modified sequence opt3 from anti-HIV_CDR
  source 1..15: mol_type = other RNA
cagaaggccaccaca

SEQ ID NO: 28630 - RNA, 15 nt, synthetic construct
  misc_feature 1..15: note = derived and/or modified sequence opt3 from anti-HIV_CDR
  source 1..15: mol_type = other RNA
ctgttcgccggcacc

SEQ ID NO: 28631 - RNA, 18 nt, synthetic construct
  misc_feature 1..18: note = derived and/or modified sequence opt3 from anti-HIV_CDR
  source 1..18: mol_type = other RNA
gtgagaggcagctccccc

SEQ ID NO: 28632 - RNA, 18 nt, synthetic construct
  misc_feature 1..18: note = derived and/or modified sequence opt3 from anti-HIV_CDR
  source 1..18: mol_type = other RNA
ggcctcctgttcgtggtc

SEQ ID NO: 28633 - RNA, 18 nt, synthetic construct
  misc_feature 1..18: note = derived and/or modified sequence opt3 from anti-HIV_CDR
  source 1..18: mol_type = other RNA
atggactggacctggagc

SEQ ID NO: 28634 - RNA, 18 nt, synthetic construct
  misc_feature 1..18: note = derived and/or modified sequence opt3 from anti-HIV_CDR
  source 1..18: mol_type = other RNA
atggactggacctggaga

SEQ ID NO: 28635 - RNA, 18 nt, synthetic construct
  misc_feature 1..18: note = derived and/or modified sequence opt3 from anti-HIV_CDR
  source 1..18: mol_type = other RNA
atgaagcacctgtggttc

SEQ ID NO: 28636 - RNA, 18 nt, synthetic construct
  misc_feature 1..18: note = derived and/or modified sequence opt3 from anti-HIV_CDR
  source 1..18: mol_type = other RNA
atggactggatctggaga

SEQ ID NO: 28637 - RNA, 18 nt, synthetic construct
  misc_feature 1..18: note = derived and/or modified sequence opt3 from anti-HIV_CDR
  source 1..18: mol_type = other RNA
atggactggacctggaca

SEQ ID NO: 28638 - RNA, 18 nt, synthetic construct
  misc_feature 1..18: note = derived and/or modified sequence opt3 from anti-HIV_CDR
  source 1..18: mol_type = other RNA
atgaagcacctgttcctc

SEQ ID NO: 28639 - RNA, 18 nt, synthetic construct
  misc_feature 1..18: note = derived and/or modified sequence opt3 from anti-HIV_CDR
  source 1..18: mol_type = other RNA
cagctgctccaaagcaac

SEQ ID NO: 28640 - RNA, 18 nt, synthetic construct
  misc_feature 1..18: note = derived and/or modified sequence opt3 from anti-HIV_CDR
  source 1..18: mol_type = other RNA
ggcgggagccccgagcac

SEQ ID NO: 28641 - RNA, 18 nt, synthetic construct
  misc_feature 1..18: note = derived and/or modified sequence opt3 from anti-HIV_CDR
  source 1..18: mol_type = other RNA
ctggagggcaccgactac

SEQ ID NO: 28642 - RNA, 18 nt, synthetic construct
  misc_feature 1..18: note = derived and/or modified sequence opt3 from anti-HIV_CDR
  source 1..18: mol_type = other RNA
cagcaataccccagcacc

SEQ ID NO: 28643 - RNA, 21 nt, synthetic construct
  misc_feature 1..21: note = derived and/or modified sequence opt3 from anti-HIV_CDR
  source 1..21: mol_type = other RNA
aacaatcacgacagacccagc

SEQ ID NO: 28644 - RNA, 21 nt, synthetic construct
  misc_feature 1..21: note = derived and/or modified sequence opt3 from anti-HIV_CDR
  source 1..21: mol_type = other RNA
aacaatcaggacagacccgcc

SEQ ID NO: 28645 - RNA, 21 nt, synthetic construct
  misc_feature 1..21: note = derived and/or modified sequence opt3 from anti-HIV_CDR
  source 1..21: mol_type = other RNA
aacaataacgacagacccagc

SEQ ID NO: 28646 - RNA, 21 nt, synthetic construct
  misc_feature 1..21: note = derived and/or modified sequence opt3 from anti-HIV_CDR
  source 1..21: mol_type = other RNA
aacaatcaggacagacccagc

SEQ ID NO: 28647 - RNA, 21 nt, synthetic construct
  misc_feature 1..21: note = derived and/or modified sequence opt3 from anti-HIV_CDR
  source 1..21: mol_type = other RNA
gacgatagcgacagaccctcc

SEQ ID NO: 28648 - RNA, 21 nt, synthetic construct
  misc_feature 1..21: note = derived and/or modified sequence opt3 from anti-HIV_CDR
  source 1..21: mol_type = other RNA
tgggccagcaccagacacaca

SEQ ID NO: 28649 - RNA, 21 nt, synthetic construct
  misc_feature 1..21: note = derived and/or modified sequence opt3 from anti-HIV_CDR
  source 1..21: mol_type = other RNA
ggcgccaccgctagagacttc

SEQ ID NO: 28650 - RNA, 21 nt, synthetic construct
  misc_feature 1..21: note = derived and/or modified sequence opt3 from anti-HIV_CDR
  source 1..21: mol_type = other RNA
gccagcatcaagctggctctc

SEQ ID NO: 28651 - RNA, 21 nt, synthetic construct
  misc_feature 1..21: note = derived and/or modified sequence opt3 from anti-HIV_CDR
  source 1..21: mol_type = other RNA
cagcaatacggcagaagcccc

SEQ ID NO: 28652 - RNA, 21 nt, synthetic construct
  misc_feature 1..21: note = derived and/or modified sequence opt3 from anti-HIV_CDR
  source 1..21: mol_type = other RNA
cagcaatactatatcagcccc

SEQ ID NO: 28653 - RNA, 21 nt, synthetic construct
  misc_feature 1..21: note = derived and/or modified sequence opt3 from anti-HIV_CDR
  source 1..21: mol_type = other RNA
cagcaaagccactccccctct

SEQ ID NO: 28654 - RNA, 21 nt, synthetic construct
  misc_feature 1..21: note = derived and/or modified sequence opt3 from anti-HIV_CDR
  source 1..21: mol_type = other RNA
ggcagatgcgccaggcggtgg

SEQ ID NO: 28655 - RNA, 21 nt, synthetic construct
  misc_feature 1..21: note = derived and/or modified sequence opt3 from anti-HIV_CDR
  source 1..21: mol_type = other RNA
agattcctgtttgtggtcgcc

SEQ ID NO: 28656 - RNA, 21 nt, synthetic construct
  misc_feature 1..21: note = derived and/or modified sequence opt3 from anti-HIV_CDR
  source 1..21: mol_type = other RNA
atgagcgtgtccttcctgatc

SEQ ID NO: 28657 - RNA, 21 nt, synthetic construct
  misc_feature 1..21: note = derived and/or modified sequence opt3 from anti-HIV_CDR
  source 1..21: mol_type = other RNA
ggcagctccaacagatgcccc

SEQ ID NO: 28658 - RNA, 21 nt, synthetic construct
  misc_feature 1..21: note = derived and/or modified sequence opt3 from anti-HIV_CDR
  source 1..21: mol_type = other RNA
atgaagcacctgtggttcttt

SEQ ID NO: 28659 - RNA, 21 nt, synthetic construct
  misc_feature 1..21: note = derived and/or modified sequence opt3 from anti-HIV_CDR
  source 1..21: mol_type = other RNA
gccagctgggacttcgatttt

SEQ ID NO: 28660 - RNA, 21 nt, synthetic construct
  misc_feature 1..21: note = derived and/or modified sequence opt3 from anti-HIV_CDR
  source 1..21: mol_type = other RNA
gagatcggcgtggccgaacac

SEQ ID NO: 28661 - RNA, 21 nt, synthetic construct
  misc_feature 1..21: note = derived and/or modified sequence opt3 from anti-HIV_CDR
  source 1..21: mol_type = other RNA
cagaagtacgacaccgccccc

SEQ ID NO: 28662 - RNA, 21 nt, synthetic construct
  misc_feature 1..21: note = derived and/or modified sequence opt3 from anti-HIV_CDR
  source 1..21: mol_type = other RNA
cagcaaagctcctctaccccc

SEQ ID NO: 28663 - RNA, 21 nt, synthetic construct
  misc_feature 1..21: note = derived and/or modified sequence opt3 from anti-HIV_CDR
  source 1..21: mol_type = other RNA
cagcaaagcgccggcaccccc

SEQ ID NO: 28664 - RNA, 21 nt, synthetic construct
  misc_feature 1..21: note = derived and/or modified sequence opt3 from anti-HIV_CDR
  source 1..21: mol_type = other RNA
cagcaaagctcctctaagccc

SEQ ID NO: 28665 - RNA, 21 nt, synthetic construct
  misc_feature 1..21: note = derived and/or modified sequence opt3 from anti-HIV_CDR
  source 1..21: mol_type = other RNA
caggagtacaacacctataca

SEQ ID NO: 28666 - RNA, 21 nt, synthetic construct
  misc_feature 1..21: note = derived and/or modified sequence opt3 from anti-HIV_CDR
  source 1..21: mol_type = other RNA
caggagtacaacaattataac

SEQ ID NO: 28667 - RNA, 21 nt, synthetic construct
  misc_feature 1..21: note = derived and/or modified sequence opt3 from anti-HIV_CDR
  source 1..21: mol_type = other RNA
cactacgacgccctggattat

SEQ ID NO: 28668 - RNA, 24 nt, synthetic construct
  misc_feature 1..24: note = derived and/or modified sequence opt3 from anti-HIV_CDR
  source 1..24: mol_type = other RNA
gccatcttcaagggcgtgcagtgc

SEQ ID NO: 28669 - RNA, 24 nt, synthetic construct
  misc_feature 1..24: note = derived and/or modified sequence opt3 from anti-HIV_CDR
  source 1..24: mol_type = other RNA
ggccccctgggggactacgatttc

SEQ ID NO: 28670 - RNA, 24 nt, synthetic construct
  misc_feature 1..24: note = derived and/or modified sequence opt3 from anti-HIV_CDR
  source 1..24: mol_type = other RNA
cagcaatacggcagctccctgaga

SEQ ID NO: 28671 - RNA, 24 nt, synthetic construct
  misc_feature 1..24: note = derived and/or modified sequence opt3 from anti-HIV_CDR
  source 1..24: mol_type = other RNA
cagcaatacagccactatagaacc

SEQ ID NO: 28672 - RNA, 24 nt, synthetic construct
  misc_feature 1..24: note = derived and/or modified sequence opt3 from anti-HIV_CDR
  source 1..24: mol_type = other RNA
cagtactatggcatgagcgtgacc

SEQ ID NO: 28673 - RNA, 24 nt, synthetic construct
  misc_feature 1..24: note = derived and/or modified sequence opt3 from anti-HIV_CDR
  source 1..24: mol_type = other RNA
cagcaatacgagaactggctgacc

SEQ ID NO: 28674 - RNA, 24 nt, synthetic construct
  misc_feature 1..24: note = derived and/or modified sequence opt3 from anti-HIV_CDR
  source 1..24: mol_type = other RNA
agcggcgtgcactacatggacgtc

SEQ ID NO: 28675 - RNA, 24 nt, synthetic construct
  misc_feature 1..24: note = derived and/or modified sequence opt3 from anti-HIV_CDR
  source 1..24: mol_type = other RNA
cagcaatacagcggccccctgacc

SEQ ID NO: 28676 - RNA, 24 nt, synthetic construct
  misc_feature 1..24: note = derived and/or modified sequence opt3 from anti-HIV_CDR
  source 1..24: mol_type = other RNA
cagcaatactataccgtgcccagc

SEQ ID NO: 28677 - RNA, 24 nt, synthetic construct
  misc_feature 1..24: note = derived and/or modified sequence opt3 from anti-HIV_CDR
  source 1..24: mol_type = other RNA
cagcaatacggcagctccatcacc

SEQ ID NO: 28678 - RNA, 24 nt, synthetic construct
  misc_feature 1..24: note = derived and/or modified sequence opt3 from anti-HIV_CDR
  source 1..24: mol_type = other RNA
caccagtacaacaagtgggacacc

SEQ ID NO: 28679 - RNA, 24 nt, synthetic construct
  misc_feature 1..24: note = derived and/or modified sequence opt3 from anti-HIV_CDR
  source 1..24: mol_type = other RNA
cagcaaagctacaccacacccctg

SEQ ID NO: 28680 - RNA, 24 nt, synthetic construct
  misc_feature 1..24: note = derived and/or modified sequence opt3 from anti-HIV_CDR
  source 1..24: mol_type = other RNA
cagagatgggagaccatcgactac

SEQ ID NO: 28681 - RNA, 24 nt, synthetic construct
  misc_feature 1..24: note = derived and/or modified sequence opt3 from anti-HIV_CDR
  source 1..24: mol_type = other RNA
tgcagctacgccggctcctatacc

SEQ ID NO: 28682 - RNA, 24 nt, synthetic construct
  misc_feature 1..24: note = derived and/or modified sequence opt3 from anti-HIV_CDR
  source 1..24: mol_type = other RNA
cagcaatacgacaacctgcccacc

SEQ ID NO: 28683 - RNA, 24 nt, synthetic construct
  misc_feature 1..24: note = derived and/or modified sequence opt3 from anti-HIV_CDR
  source 1..24: mol_type = other RNA
cagcaatgcaccctgcccctcaca

SEQ ID NO: 28684 - RNA, 24 nt, synthetic construct
  misc_feature 1..24: note = derived and/or modified sequence opt3 from anti-HIV_CDR
  source 1..24: mol_type = other RNA
cagcaaagctactcctctgtgacc

SEQ ID NO: 28685 - RNA, 24 nt, synthetic construct
  misc_feature 1..24: note = derived and/or modified sequence opt3 from anti-HIV_CDR
  source 1..24: mol_type = other RNA
cagcaaagccacacctccgtgaca

SEQ ID NO: 28686 - RNA, 24 nt, synthetic construct
  misc_feature 1..24: note = derived and/or modified sequence opt3 from anti-HIV_CDR
  source 1..24: mol_type = other RNA
cagcaaacctacgccagcgtgaca

SEQ ID NO: 28687 - RNA, 24 nt, synthetic construct
  misc_feature 1..24: note = derived and/or modified sequence opt3 from anti-HIV_CDR
  source 1..24: mol_type = other RNA
cagcaatacaacagcgactatacc

SEQ ID NO: 28688 - RNA, 24 nt, synthetic construct
  misc_feature 1..24: note = derived and/or modified sequence opt3 from anti-HIV_CDR
  source 1..24: mol_type = other RNA
cacctgtacgtgagcagacccgtc

SEQ ID NO: 28689 - RNA, 24 nt, synthetic construct
  misc_feature 1..24: note = derived and/or modified sequence opt3 from anti-HIV_CDR
  source 1..24: mol_type = other RNA
cagcaatacggcagaagccccctg

SEQ ID NO: 28690 - RNA, 24 nt, synthetic construct
  misc_feature 1..24: note = derived and/or modified sequence opt3 from anti-HIV_CDR
  source 1..24: mol_type = other RNA
cagcaatacggctccagccccctg

SEQ ID NO: 28691 - RNA, 24 nt, synthetic construct
  misc_feature 1..24: note = derived and/or modified sequence opt3 from anti-HIV_CDR
  source 1..24: mol_type = other RNA
cagcaatacaacgactggcccgcc

SEQ ID NO: 28692 - RNA, 24 nt, synthetic construct
  misc_feature 1..24: note = derived and/or modified sequence opt3 from anti-HIV_CDR
  source 1..24: mol_type = other RNA
caccagtacggcagctcccaaaga

SEQ ID NO: 28693 - RNA, 24 nt, synthetic construct
  misc_feature 1..24: note = derived and/or modified sequence opt3 from anti-HIV_CDR
  source 1..24: mol_type = other RNA
cagcaaacctacagctccgtgaca

SEQ ID NO: 28694 - RNA, 24 nt, synthetic construct
  misc_feature 1..24: note = derived and/or modified sequence opt3 from anti-HIV_CDR
  source 1..24: mol_type = other RNA
cagcaaacctacagaagcgtgaca

SEQ ID NO: 28695 - RNA, 24 nt, synthetic construct
  misc_feature 1..24: note = derived and/or modified sequence opt3 from anti-HIV_CDR
  source 1..24: mol_type = other RNA
cagcaatacggcagctcctggacc

SEQ ID NO: 28696 - RNA, 24 nt, synthetic construct
  misc_feature 1..24: note = derived and/or modified sequence opt3 from anti-HIV_CDR
  source 1..24: mol_type = other RNA
agctcctacgccggcatcaacaat

SEQ ID NO: 28697 - RNA, 24 nt, synthetic construct
  misc_feature 1..24: note = derived and/or modified sequence opt3 from anti-HIV_CDR
  source 1..24: mol_type = other RNA
cagaagtacggcagctccctgacc

SEQ ID NO: 28698 - RNA, 24 nt, synthetic construct
  misc_feature 1..24: note = derived and/or modified sequence opt3 from anti-HIV_CDR
  source 1..24: mol_type = other RNA
atgcaggccctggagaccctcggc

SEQ ID NO: 28699 - RNA, 24 nt, synthetic construct
  misc_feature 1..24: note = derived and/or modified sequence opt3 from anti-HIV_CDR
  source 1..24: mol_type = other RNA
cagcaatacgccggcagcctgacc

SEQ ID NO: 28700 - RNA, 24 nt, synthetic construct
  misc_feature 1..24: note = derived and/or modified sequence opt3 from anti-HIV_CDR
  source 1..24: mol_type = other RNA
agaaactggggcaatttcgaccac

SEQ ID NO: 28701 - RNA, 27 nt, synthetic construct
  misc_feature 1..27: note = derived and/or modified sequence opt3 from anti-HIV_CDR
  source 1..27: mol_type = other RNA
cagcaacactacaccacaccctggact

SEQ ID NO: 28702 - RNA, 27 nt, synthetic construct
  misc_feature 1..27: note = derived and/or modified sequence opt3 from anti-HIV_CDR
  source 1..27: mol_type = other RNA
caacagagcttcgccgtgccctacacc

SEQ ID NO: 28703 - RNA, 27 nt, synthetic construct
  misc_feature 1..27: note = derived and/or modified sequence opt3 from anti-HIV_CDR
  source 1..27: mol_type = other RNA
cagcaatacaagagctattccggcacc

SEQ ID NO: 28704 - RNA, 27 nt, synthetic construct
  misc_feature 1..27: note = derived and/or modified sequence opt3 from anti-HIV_CDR
  source 1..27: mol_type = other RNA
caccagtacgcctatagccccagaacc

SEQ ID NO: 28705 - RNA, 27 nt, synthetic construct
  misc_feature 1..27: note = derived and/or modified sequence opt3 from anti-HIV_CDR
  source 1..27: mol_type = other RNA
cagcaatacaacagcttccctcccacc

SEQ ID NO: 28706 - RNA, 27 nt, synthetic construct
  misc_feature 1..27: note = derived and/or modified sequence opt3 from anti-HIV_CDR
  source 1..27: mol_type = other RNA
cagcaaacctacagcaaccccagaatg

SEQ ID NO: 28707 - RNA, 27 nt, synthetic construct
  misc_feature 1..27: note = derived and/or modified sequence opt3 from anti-HIV_CDR
  source 1..27: mol_type = other RNA
cagcaatacgaggaccctccctggacc

SEQ ID NO: 28708 - RNA, 27 nt, synthetic construct
  misc_feature 1..27: note = derived and/or modified sequence opt3 from anti-HIV_CDR
  source 1..27: mol_type = other RNA
caccagtacttcaacacccccagaaca

SEQ ID NO: 28709 - RNA, 27 nt, synthetic construct
  misc_feature 1..27: note = derived and/or modified sequence opt3 from anti-HIV_CDR
  source 1..27: mol_type = other RNA
caccagtacttcagcacccccagaaca

SEQ ID NO: 28710 - RNA, 27 nt, synthetic construct
  misc_feature 1..27: note = derived and/or modified sequence opt3 from anti-HIV_CDR
  source 1..27: mol_type = other RNA
cagcacagaagcaactggccctggacc

SEQ ID NO: 28711 - RNA, 27 nt, synthetic construct
  misc_feature 1..27: note = derived and/or modified sequence opt3 from anti-HIV_CDR
  source 1..27: mol_type = other RNA
agaggcaggcggcagatcggggactac

SEQ ID NO: 28712 - RNA, 27 nt, synthetic construct
  misc_feature 1..27: note = derived and/or modified sequence opt3 from anti-HIV_CDR
  source 1..27: mol_type = other RNA
cagcaatacggcctgagcccctggacc

SEQ ID NO: 28713 - RNA, 27 nt, synthetic construct
  misc_feature 1..27: note = derived and/or modified sequence opt3 from anti-HIV_CDR
  source 1..27: mol_type = other RNA
cagcaaacctacacaagccccatcact

SEQ ID NO: 28714 - RNA, 27 nt, synthetic construct
  misc_feature 1..27: note = derived and/or modified sequence opt3 from anti-HIV_CDR
  source 1..27: mol_type = other RNA
cagcaatacggcagctcccctcccacc

SEQ ID NO: 28715 - RNA, 27 nt, synthetic construct
  misc_feature 1..27: note = derived and/or modified sequence opt3 from anti-HIV_CDR
  source 1..27: mol_type = other RNA
cagcaatacggcaccagctcctgcaca

SEQ ID NO: 28716 - RNA, 27 nt, synthetic construct
  misc_feature 1..27: note = derived and/or modified sequence opt3 from anti-HIV_CDR
  source 1..27: mol_type = other RNA
cagcaatacgacgatgcccccatcacc

SEQ ID NO: 28717 - RNA, 27 nt, synthetic construct
  misc_feature 1..27: note = derived and/or modified sequence opt3 from anti-HIV_CDR
  source 1..27: mol_type = other RNA
ggccccctgctcagataccttgacagc

SEQ ID NO: 28718 - RNA, 27 nt, synthetic construct
  misc_feature 1..27: note = derived and/or modified sequence opt3 from anti-HIV_CDR
  source 1..27: mol_type = other RNA
tgcctgaagaaaaccagctcctacgtg

SEQ ID NO: 28719 - RNA, 27 nt, synthetic construct
  misc_feature 1..27: note = derived and/or modified sequence opt3 from anti-HIV_CDR
  source 1..27: mol_type = other RNA
cagcaatacaaccactggccccagacc

SEQ ID NO: 28720 - RNA, 27 nt, synthetic construct
  misc_feature 1..27: note = derived and/or modified sequence opt3 from anti-HIV_CDR
  source 1..27: mol_type = other RNA
cagcaatacagcaacctgccctatacc

SEQ ID NO: 28721 - RNA, 27 nt, synthetic construct
  misc_feature 1..27: note = derived and/or modified sequence opt3 from anti-HIV_CDR
  source 1..27: mol_type = other RNA
cagcaatacgacacctatcccggcaca

SEQ ID NO: 28722 - RNA, 27 nt, synthetic construct
  misc_feature 1..27: note = derived and/or modified sequence opt3 from anti-HIV_CDR
  source 1..27: mol_type = other RNA
caggagtacagctccaccccctataac

SEQ ID NO: 28723 - RNA, 27 nt, synthetic construct
  misc_feature 1..27: note = derived and/or modified sequence opt3 from anti-HIV_CDR
  source 1..27: mol_type = other RNA
ggcgcctgggacgataccctgtacgtg

SEQ ID NO: 28724 - RNA, 27 nt, synthetic construct
  misc_feature 1..27: note = derived and/or modified sequence opt3 from anti-HIV_CDR
  source 1..27: mol_type = other RNA
gccgcttgggacgataccctgtacgtg

SEQ ID NO: 28725 - RNA, 27 nt, synthetic construct
  misc_feature 1..27: note = derived and/or modified sequence opt3 from anti-HIV_CDR
  source 1..27: mol_type = other RNA
cagcaatactatagcgactccatcacc

SEQ ID NO: 28726 - RNA, 27 nt, synthetic construct
  misc_feature 1..27: note = derived and/or modified sequence opt3 from anti-HIV_CDR
  source 1..27: mol_type = other RNA
cagcaatacggcagaagcccctatacc

SEQ ID NO: 28727 - RNA, 27 nt, synthetic construct
  misc_feature 1..27: note = derived and/or modified sequence opt3 from anti-HIV_CDR
  source 1..27: mol_type = other RNA
cagcaatacaccaactatccctggaca

SEQ ID NO: 28728 - RNA, 27 nt, synthetic construct
  misc_feature 1..27: note = derived and/or modified sequence opt3 from anti-HIV_CDR
  source 1..27: mol_type = other RNA
cagcaaagacacaactggcccatcagc

SEQ ID NO: 28729 - RNA, 27 nt, synthetic construct
  misc_feature 1..27: note = derived and/or modified sequence opt3 from anti-HIV_CDR
  source 1..27: mol_type = other RNA
cagcaataccacaactggcccagaacc

SEQ ID NO: 28730 - RNA, 27 nt, synthetic construct
  misc_feature 1..27: note = derived and/or modified sequence opt3 from anti-HIV_CDR
  source 1..27: mol_type = other RNA
cagcaaagaagcacctggccccctaca

SEQ ID NO: 28731 - RNA, 27 nt, synthetic construct
  misc_feature 1..27: note = derived and/or modified sequence opt3 from anti-HIV_CDR
  source 1..27: mol_type = other RNA
cagcaatacgacagcttctcctggacc

SEQ ID NO: 28732 - RNA, 27 nt, synthetic construct
  misc_feature 1..27: note = derived and/or modified sequence opt3 from anti-HIV_CDR
  source 1..27: mol_type = other RNA
cagcaatacaacaatctgcccgtgacc

SEQ ID NO: 28733 - RNA, 27 nt, synthetic construct
  misc_feature 1..27: note = derived and/or modified sequence opt3 from anti-HIV_CDR
  source 1..27: mol_type = other RNA
cagcaatacaacagatatagctacacc

SEQ ID NO: 28734 - RNA, 27 nt, synthetic construct
  misc_feature 1..27: note = derived and/or modified sequence opt3 from anti-HIV_CDR
  source 1..27: mol_type = other RNA
caggagtactatatcctgccctgcagc

SEQ ID NO: 28735 - RNA, 27 nt, synthetic construct
  misc_feature 1..27: note = derived and/or modified sequence opt3 from anti-HIV_CDR
  source 1..27: mol_type = other RNA
cagcaatacgacaacctgctcgcccac

SEQ ID NO: 28736 - RNA, 27 nt, synthetic construct
  misc_feature 1..27: note = derived and/or modified sequence opt3 from anti-HIV_CDR
  source 1..27: mol_type = other RNA
caccagtgcgacaacctgatcgccaga

SEQ ID NO: 28737 - RNA, 27 nt, synthetic construct
  misc_feature 1..27: note = derived and/or modified sequence opt3 from anti-HIV_CDR
  source 1..27: mol_type = other RNA
caacagagcttctccaccctgtggaca

SEQ ID NO: 28738 - RNA, 27 nt, synthetic construct
  misc_feature 1..27: note = derived and/or modified sequence opt3 from anti-HIV_CDR
  source 1..27: mol_type = other RNA
caccagagctactccacaccccctacc

SEQ ID NO: 28739 - RNA, 27 nt, synthetic construct
  misc_feature 1..27: note = derived and/or modified sequence opt3 from anti-HIV_CDR
  source 1..27: mol_type = other RNA
cagcaaggctacagcaccccctggaca

SEQ ID NO: 28740 - RNA, 27 nt, synthetic construct
  misc_feature 1..27: note = derived and/or modified sequence opt3 from anti-HIV_CDR
  source 1..27: mol_type = other RNA
cagcaatacagcaccacacccagaact

SEQ ID NO: 28741 - RNA, 27 nt, synthetic construct
  misc_feature 1..27: note = derived and/or modified sequence opt3 from anti-HIV_CDR
  source 1..27: mol_type = other RNA
cagctgtacaacagcgtgccccaaacc

SEQ ID NO: 28742 - RNA, 27 nt, synthetic construct
  misc_feature 1..27: note = derived and/or modified sequence opt3 from anti-HIV_CDR
  source 1..27: mol_type = other RNA
cagcaaagaaccagctggccccagaca

SEQ ID NO: 28743 - RNA, 27 nt, synthetic construct
  misc_feature 1..27: note = derived and/or modified sequence opt3 from anti-HIV_CDR
  source 1..27: mol_type = other RNA
cagcaattcaacacctacagccagaca

SEQ ID NO: 28744 - RNA, 27 nt, synthetic construct
  misc_feature 1..27: note = derived and/or modified sequence opt3 from anti-HIV_CDR
  source 1..27: mol_type = other RNA
atgcagagcctgcaaacccccatcaca

SEQ ID NO: 28745 - RNA, 27 nt, synthetic construct
  misc_feature 1..27: note = derived and/or modified sequence opt3 from anti-HIV_CDR
  source 1..27: mol_type = other RNA
cagcaatacaacagctatcccctgacc

SEQ ID NO: 28746 - RNA, 27 nt, synthetic construct
  misc_feature 1..27: note = derived and/or modified sequence opt3 from anti-HIV_CDR
  source 1..27: mol_type = other RNA
cagcaatacaacagctattccggcacc

SEQ ID NO: 28747 - RNA, 27 nt, synthetic construct
  misc_feature 1..27: note = derived and/or modified sequence opt3 from anti-HIV_CDR
  source 1..27: mol_type = other RNA
cagagctacgactcctctctgtcaggc

SEQ ID NO: 28748 - RNA, 27 nt, synthetic construct
  misc_feature 1..27: note = derived and/or modified sequence opt3 from anti-HIV_CDR
  source 1..27: mol_type = other RNA
agccagggcaacaccgccatcgactac

SEQ ID NO: 28749 - RNA, 27 nt, synthetic construct
  misc_feature 1..27: note = derived and/or modified sequence opt3 from anti-HIV_CDR
  source 1..27: mol_type = other RNA
gaggaacccagagacgccttcgatctg

SEQ ID NO: 28750 - RNA, 27 nt, synthetic construct
  misc_feature 1..27: note = derived and/or modified sequence opt3 from anti-HIV_CDR
  source 1..27: mol_type = other RNA
cagcaaagctacaccacacccgtgact

SEQ ID NO: 28751 - RNA, 27 nt, synthetic construct
  misc_feature 1..27: note = derived and/or modified sequence opt3 from anti-HIV_CDR
  source 1..27: mol_type = other RNA
gccggcagagaggggtggttcgacccc

SEQ ID NO: 28752 - RNA, 27 nt, synthetic construct
  misc_feature 1..27: note = derived and/or modified sequence opt3 from anti-HIV_CDR
  source 1..27: mol_type = other RNA
cagcaatactatagcacaccccacacc

SEQ ID NO: 28753 - RNA, 27 nt, synthetic construct
  misc_feature 1..27: note = derived and/or modified sequence opt3 from anti-HIV_CDR
  source 1..27: mol_type = other RNA
cagcaaagctactccatcgccggcacc

SEQ ID NO: 28754 - RNA, 27 nt, synthetic construct
  misc_feature 1..27: note = derived and/or modified sequence opt3 from anti-HIV_CDR
  source 1..27: mol_type = other RNA
cagaactacaataagccccctagaacc

SEQ ID NO: 28755 - RNA, 27 nt, synthetic construct
  misc_feature 1..27: note = derived and/or modified sequence opt3 from anti-HIV_CDR
  source 1..27: mol_type = other RNA
atgcagagcatccaactgcccctcacc

SEQ ID NO: 28756 - RNA, 27 nt, synthetic construct
  misc_feature 1..27: note = derived and/or modified sequence opt3 from anti-HIV_CDR
  source 1..27: mol_type = other RNA
atgcaggccctgcaaaccagcctcaca

SEQ ID NO: 28757 - RNA, 27 nt, synthetic construct
  misc_feature 1..27: note = derived and/or modified sequence opt3 from anti-HIV_CDR
  source 1..27: mol_type = other RNA
cagcaatacagctcctctcccagaacc

SEQ ID NO: 28758 - RNA, 27 nt, synthetic construct
  misc_feature 1..27: note = derived and/or modified sequence opt3 from anti-HIV_CDR
  source 1..27: mol_type = other RNA
caggcctgggacagctccaccgctgtg

SEQ ID NO: 28759 - RNA, 27 nt, synthetic construct
  misc_feature 1..27: note = derived and/or modified sequence opt3 from anti-HIV_CDR
  source 1..27: mol_type = other RNA
cagcactacaacaattggccctatacc

SEQ ID NO: 28760 - RNA, 27 nt, synthetic construct
  misc_feature 1..27: note = derived and/or modified sequence opt3 from anti-HIV_CDR
  source 1..27: mol_type = other RNA
cagcaatacgacagactgcccatcacc

SEQ ID NO: 28761 - RNA, 27 nt, synthetic construct
  misc_feature 1..27: note = derived and/or modified sequence opt3 from anti-HIV_CDR
  source 1..27: mol_type = other RNA
cagcaatacggcagctcccccatcacc

SEQ ID NO: 28762 - RNA, 27 nt, synthetic construct
  misc_feature 1..27: note = derived and/or modified sequence opt3 from anti-HIV_CDR
  source 1..27: mol_type = other RNA
cagcaatacgacgtgtggcccctgacc

SEQ ID NO: 28763 - RNA, 27 nt, synthetic construct
  misc_feature 1..27: note = derived and/or modified sequence opt3 from anti-HIV_CDR
  source 1..27: mol_type = other RNA
caccagtacgccagctcccccagaacc

SEQ ID NO: 28764 - RNA, 27 nt, synthetic construct
  misc_feature 1..27: note = derived and/or modified sequence opt3 from anti-HIV_CDR
  source 1..27: mol_type = other RNA
atgcagagcctgcacctcccctacacc

SEQ ID NO: 28765 - RNA, 27 nt, synthetic construct
  misc_feature 1..27: note = derived and/or modified sequence opt3 from anti-HIV_CDR
  source 1..27: mol_type = other RNA
cagcaatactattccagccccctgacc

SEQ ID NO: 28766 - RNA, 27 nt, synthetic construct
  misc_feature 1..27: note = derived and/or modified sequence opt3 from anti-HIV_CDR
  source 1..27: mol_type = other RNA
cagcaacacgacaccttcccctttaca

SEQ ID NO: 28767 - RNA, 27 nt, synthetic construct
  misc_feature 1..27: note = derived and/or modified sequence opt3 from anti-HIV_CDR
  source 1..27: mol_type = other RNA
cagcaaagctactccaccccctataca

SEQ ID NO: 28768 - RNA, 27 nt, synthetic construct
  misc_feature 1..27: note = derived and/or modified sequence opt3 from anti-HIV_CDR
  source 1..27: mol_type = other RNA
cagcaatacaagacctatcccgtgaca

SEQ ID NO: 28769 - RNA, 27 nt, synthetic construct
  misc_feature 1..27: note = derived and/or modified sequence opt3 from anti-HIV_CDR
  source 1..27: mol_type = other RNA
cagcaatactatagcacccccgtgaca

SEQ ID NO: 28770 - RNA, 27 nt, synthetic construct
  misc_feature 1..27: note = derived and/or modified sequence opt3 from anti-HIV_CDR
  source 1..27: mol_type = other RNA
cagcaatacaactggccccctttcacc

SEQ ID NO: 28771 - RNA, 27 nt, synthetic construct
  misc_feature 1..27: note = derived and/or modified sequence opt3 from anti-HIV_CDR
  source 1..27: mol_type = other RNA
atgcagggcacccactggccctggaca

SEQ ID NO: 28772 - RNA, 27 nt, synthetic construct
  misc_feature 1..27: note = derived and/or modified sequence opt3 from anti-HIV_CDR
  source 1..27: mol_type = other RNA
caccagtgcggcagctcccccagaacc

SEQ ID NO: 28773 - RNA, 27 nt, synthetic construct
  misc_feature 1..27: note = derived and/or modified sequence opt3 from anti-HIV_CDR
  source 1..27: mol_type = other RNA
cagcaatacaacagctatttcagaacc

SEQ ID NO: 28774 - RNA, 27 nt, synthetic construct
  misc_feature 1..27: note = derived and/or modified sequence opt3 from anti-HIV_CDR
  source 1..27: mol_type = other RNA
cagcaataccacaactggccccctagc

SEQ ID NO: 28775 - RNA, 27 nt, synthetic construct
  misc_feature 1..27: note = derived and/or modified sequence opt3 from anti-HIV_CDR
  source 1..27: mol_type = other RNA
atgcagggcacctactggctgtggaca

SEQ ID NO: 28776 - RNA, 27 nt, synthetic construct
  misc_feature 1..27: note = derived and/or modified sequence opt3 from anti-HIV_CDR
  source 1..27: mol_type = other RNA
cagcaaggcttcagcgccccctttacc

SEQ ID NO: 28777 - RNA, 27 nt, synthetic construct
  misc_feature 1..27: note = derived and/or modified sequence opt3 from anti-HIV_CDR
  source 1..27: mol_type = other RNA
cagcaatacaacacctatcccctgaca

SEQ ID NO: 28778 - RNA, 27 nt, synthetic construct
  misc_feature 1..27: note = derived and/or modified sequence opt3 from anti-HIV_CDR
  source 1..27: mol_type = other RNA
atgcagggcacccactggcccagaaca

SEQ ID NO: 28779 - RNA, 27 nt, synthetic construct
  misc_feature 1..27: note = derived and/or modified sequence opt3 from anti-HIV_CDR
  source 1..27: mol_type = other RNA
ttcggcagaaccccctggtttgaccct

SEQ ID NO: 28780 - RNA, 27 nt, synthetic construct
  misc_feature 1..27: note = derived and/or modified sequence opt3 from anti-HIV_CDR
  source 1..27: mol_type = other RNA
cagcaatacttcaccagcgtgatcaca

SEQ ID NO: 28781 - RNA, 27 nt, synthetic construct
  misc_feature 1..27: note = derived and/or modified sequence opt3 from anti-HIV_CDR
  source 1..27: mol_type = other RNA
caccattacatgagcgacctgcagacc

SEQ ID NO: 28782 - RNA, 27 nt, synthetic construct
  misc_feature 1..27: note = derived and/or modified sequence opt3 from anti-HIV_CDR
  source 1..27: mol_type = other RNA
caccattacagctcctcttcacacacc

SEQ ID NO: 28783 - RNA, 27 nt, synthetic construct
  misc_feature 1..27: note = derived and/or modified sequence opt3 from anti-HIV_CDR
  source 1..27: mol_type = other RNA
caccattacaagagcgactgccagacc

SEQ ID NO: 28784 - RNA, 27 nt, synthetic construct
  misc_feature 1..27: note = derived and/or modified sequence opt3 from anti-HIV_CDR
  source 1..27: mol_type = other RNA
cagcacagaagctcctggcccctgacc

SEQ ID NO: 28785 - RNA, 27 nt, synthetic construct
  misc_feature 1..27: note = derived and/or modified sequence opt3 from anti-HIV_CDR
  source 1..27: mol_type = other RNA
ctgcagcaccatagctacccctggacc

SEQ ID NO: 28786 - RNA, 27 nt, synthetic construct
  misc_feature 1..27: note = derived and/or modified sequence opt3 from anti-HIV_CDR
  source 1..27: mol_type = other RNA
cagcaatacggcaccagccccgggaca

SEQ ID NO: 28787 - RNA, 27 nt, synthetic construct
  misc_feature 1..27: note = derived and/or modified sequence opt3 from anti-HIV_CDR
  source 1..27: mol_type = other RNA
cagcaatacggcagctcccccaccaca

SEQ ID NO: 28788 - RNA, 27 nt, synthetic construct
  misc_feature 1..27: note = derived and/or modified sequence opt3 from anti-HIV_CDR
  source 1..27: mol_type = other RNA
cagcaatacggcaccagccccacaact

SEQ ID NO: 28789 - RNA, 27 nt, synthetic construct
  misc_feature 1..27: note = derived and/or modified sequence opt3 from anti-HIV_CDR
  source 1..27: mol_type = other RNA
atgcaggccacccactggccccctggc

SEQ ID NO: 28790 - RNA, 27 nt, synthetic construct
  misc_feature 1..27: note = derived and/or modified sequence opt3 from anti-HIV_CDR
  source 1..27: mol_type = other RNA
cagagatacaacagggacccctatatc

SEQ ID NO: 28791 - RNA, 27 nt, synthetic construct
  misc_feature 1..27: note = derived and/or modified sequence opt3 from anti-HIV_CDR
  source 1..27: mol_type = other RNA
cagcaatacgacaacctgcccctcgcc

SEQ ID NO: 28792 - RNA, 27 nt, synthetic construct
  misc_feature 1..27: note = derived and/or modified sequence opt3 from anti-HIV_CDR
  source 1..27: mol_type = other RNA
agctcctactctgccaccggcgtggct

SEQ ID NO: 28793 - RNA, 27 nt, synthetic construct
  misc_feature 1..27: note = derived and/or modified sequence opt3 from anti-HIV_CDR
  source 1..27: mol_type = other RNA
cagcactacggcaacagcagatggacc

SEQ ID NO: 28794 - RNA, 27 nt, synthetic construct
  misc_feature 1..27: note = derived and/or modified sequence opt3 from anti-HIV_CDR
  source 1..27: mol_type = other RNA
cagcaatacgagacctatccctggaca

SEQ ID NO: 28795 - RNA, 27 nt, synthetic construct
  misc_feature 1..27: note = derived and/or modified sequence opt3 from anti-HIV_CDR
  source 1..27: mol_type = other RNA
cagcaatacggcagctccccctctacc

SEQ ID NO: 28796 - RNA, 27 nt, synthetic construct
  misc_feature 1..27: note = derived and/or modified sequence opt3 from anti-HIV_CDR
  source 1..27: mol_type = other RNA
cagcaaagccagagaacaccccacacc

SEQ ID NO: 28797 - RNA, 27 nt, synthetic construct
  misc_feature 1..27: note = derived and/or modified sequence opt3 from anti-HIV_CDR
  source 1..27: mol_type = other RNA
cagcaatacgacatcctgcccctcacc

SEQ ID NO: 28798 - RNA, 27 nt, synthetic construct
  misc_feature 1..27: note = derived and/or modified sequence opt3 from anti-HIV_CDR
  source 1..27: mol_type = other RNA
cagcaaagcaactcctctccctggacc

SEQ ID NO: 28799 - RNA, 27 nt, synthetic construct
  misc_feature 1..27: note = derived and/or modified sequence opt3 from anti-HIV_CDR
  source 1..27: mol_type = other RNA
cagcaaagctacgacacccccagaaca

SEQ ID NO: 28800 - RNA, 27 nt, synthetic construct
  misc_feature 1..27: note = derived and/or modified sequence opt3 from anti-HIV_CDR
  source 1..27: mol_type = other RNA
cagcaattcggcagctcccccgggacc

SEQ ID NO: 28801 - RNA, 27 nt, synthetic construct
  misc_feature 1..27: note = derived and/or modified sequence opt3 from anti-HIV_CDR
  source 1..27: mol_type = other RNA
caccagtacggctccagcccccaaacc

SEQ ID NO: 28802 - RNA, 27 nt, synthetic construct
  misc_feature 1..27: note = derived and/or modified sequence opt3 from anti-HIV_CDR
  source 1..27: mol_type = other RNA
caccagtacggcagctctccccaatcc

SEQ ID NO: 28803 - RNA, 27 nt, synthetic construct
  misc_feature 1..27: note = derived and/or modified sequence opt3 from anti-HIV_CDR
  source 1..27: mol_type = other RNA
ctgcagcacaacagctaccccctcacc

SEQ ID NO: 28804 - RNA, 27 nt, synthetic construct
  misc_feature 1..27: note = derived and/or modified sequence opt3 from anti-HIV_CDR
  source 1..27: mol_type = other RNA
cagcaatacaacgactggcccatcacc

SEQ ID NO: 28805 - RNA, 27 nt, synthetic construct
  misc_feature 1..27: note = derived and/or modified sequence opt3 from anti-HIV_CDR
  source 1..27: mol_type = other RNA
cagcaaaccttcacatttccctacact

SEQ ID NO: 28806 - RNA, 27 nt, synthetic construct
  misc_feature 1..27: note = derived and/or modified sequence opt3 from anti-HIV_CDR
  source 1..27: mol_type = other RNA
cagcaaagctacaccttcccctatatc

SEQ ID NO: 28807 - RNA, 27 nt, synthetic construct
  misc_feature 1..27: note = derived and/or modified sequence opt3 from anti-HIV_CDR
  source 1..27: mol_type = other RNA
cagtactatggcagctccccctacacc

SEQ ID NO: 28808 - RNA, 27 nt, synthetic construct
  misc_feature 1..27: note = derived and/or modified sequence opt3 from anti-HIV_CDR
  source 1..27: mol_type = other RNA
caacagagcttcggcacccccagaaca

SEQ ID NO: 28809 - RNA, 27 nt, synthetic construct
  misc_feature 1..27: note = derived and/or modified sequence opt3 from anti-HIV_CDR
  source 1..27: mol_type = other RNA
cagcaatacaacgactggcccagaacc

SEQ ID NO: 28810 - RNA, 27 nt, synthetic construct
  misc_feature 1..27: note = derived and/or modified sequence opt3 from anti-HIV_CDR
  source 1..27: mol_type = other RNA
cagcaatacggcagctcccccagaacc

SEQ ID NO: 28811 - RNA, 27 nt, synthetic construct
  misc_feature 1..27: note = derived and/or modified sequence opt3 from anti-HIV_CDR
  source 1..27: mol_type = other RNA
ctgcagcacaacagatacccctggacc

SEQ ID NO: 28812 - RNA, 27 nt, synthetic construct
  misc_feature 1..27: note = derived and/or modified sequence opt3 from anti-HIV_CDR
  source 1..27: mol_type = other RNA
ctgcagcacaacaattacccctggacc

SEQ ID NO: 28813 - RNA, 27 nt, synthetic construct
  misc_feature 1..27: note = derived and/or modified sequence opt3 from anti-HIV_CDR
  source 1..27: mol_type = other RNA
ctgcagtacagcacctatcccctcaca

SEQ ID NO: 28814 - RNA, 27 nt, synthetic construct
  misc_feature 1..27: note = derived and/or modified sequence opt3 from anti-HIV_CDR
  source 1..27: mol_type = other RNA
ctgcagtacaacgcctatcccctcacc

SEQ ID NO: 28815 - RNA, 27 nt, synthetic construct
  misc_feature 1..27: note = derived and/or modified sequence opt3 from anti-HIV_CDR
  source 1..27: mol_type = other RNA
cagcaatacgacagcgcccccgtgacc

SEQ ID NO: 28816 - RNA, 27 nt, synthetic construct
  misc_feature 1..27: note = derived and/or modified sequence opt3 from anti-HIV_CDR
  source 1..27: mol_type = other RNA
cagcaaacctacacattcccctatagc

SEQ ID NO: 28817 - RNA, 27 nt, synthetic construct
  misc_feature 1..27: note = derived and/or modified sequence opt3 from anti-HIV_CDR
  source 1..27: mol_type = other RNA
ggctacgacaacagcgggcccgattat

SEQ ID NO: 28818 - RNA, 27 nt, synthetic construct
  misc_feature 1..27: note = derived and/or modified sequence opt3 from anti-HIV_CDR
  source 1..27: mol_type = other RNA
cagcaatacaacaattggccccctgcc

SEQ ID NO: 28819 - RNA, 27 nt, synthetic construct
  misc_feature 1..27: note = derived and/or modified sequence opt3 from anti-HIV_CDR
  source 1..27: mol_type = other RNA
caccagtacgccctgagcccctggacc

SEQ ID NO: 28820 - RNA, 27 nt, synthetic construct
  misc_feature 1..27: note = derived and/or modified sequence opt3 from anti-HIV_CDR
  source 1..27: mol_type = other RNA
cagaagtacgacaccgatcccatgaca

SEQ ID NO: 28821 - RNA, 27 nt, synthetic construct
  misc_feature 1..27: note = derived and/or modified sequence opt3 from anti-HIV_CDR
  source 1..27: mol_type = other RNA
cagcaatacaactattaccccatcacc

SEQ ID NO: 28822 - RNA, 27 nt, synthetic construct
  misc_feature 1..27: note = derived and/or modified sequence opt3 from anti-HIV_CDR
  source 1..27: mol_type = other RNA
cagcaaaccttcacagaccccgtgact

SEQ ID NO: 28823 - RNA, 27 nt, synthetic construct
  misc_feature 1..27: note = derived and/or modified sequence opt3 from anti-HIV_CDR
  source 1..27: mol_type = other RNA
gccgcttgggacgatagcctgcacgtg

SEQ ID NO: 28824 - RNA, 27 nt, synthetic construct
  misc_feature 1..27: note = derived and/or modified sequence opt3 from anti-HIV_CDR
  source 1..27: mol_type = other RNA
cagcaatacgccagctcccccttcacc

SEQ ID NO: 28825 - RNA, 27 nt, synthetic construct
  misc_feature 1..27: note = derived and/or modified sequence opt3 from anti-HIV_CDR
  source 1..27: mol_type = other RNA
cagcaaagctcctctacccccttcaca

SEQ ID NO: 28826 - RNA, 27 nt, synthetic construct
  misc_feature 1..27: note = derived and/or modified sequence opt3 from anti-HIV_CDR
  source 1..27: mol_type = other RNA
cagcaaagaagcaactgggccatcacc

SEQ ID NO: 28827 - RNA, 27 nt, synthetic construct
  misc_feature 1..27: note = derived and/or modified sequence opt3 from anti-HIV_CDR
  source 1..27: mol_type = other RNA
cagcaatacggcagctcccccttcacc

SEQ ID NO: 28828 - RNA, 27 nt, synthetic construct
  misc_feature 1..27: note = derived and/or modified sequence opt3 from anti-HIV_CDR
  source 1..27: mol_type = other RNA
cagaagtacaacggcgccccctggacc

SEQ ID NO: 28829 - RNA, 27 nt, synthetic construct
  misc_feature 1..27: note = derived and/or modified sequence opt3 from anti-HIV_CDR
  source 1..27: mol_type = other RNA
cagaagtacaacaatgccccctggacc

SEQ ID NO: 28830 - RNA, 27 nt, synthetic construct
  misc_feature 1..27: note = derived and/or modified sequence opt3 from anti-HIV_CDR
  source 1..27: mol_type = other RNA
cagcaaagagtgaactggccccctaat

SEQ ID NO: 28831 - RNA, 27 nt, synthetic construct
  misc_feature 1..27: note = derived and/or modified sequence opt3 from anti-HIV_CDR
  source 1..27: mol_type = other RNA
cagcaaagaggccactggcccctgacc

SEQ ID NO: 28832 - RNA, 27 nt, synthetic construct
  misc_feature 1..27: note = derived and/or modified sequence opt3 from anti-HIV_CDR
  source 1..27: mol_type = other RNA
cagcaatacagatatagcgtgatcatt

SEQ ID NO: 28833 - RNA, 27 nt, synthetic construct
  misc_feature 1..27: note = derived and/or modified sequence opt3 from anti-HIV_CDR
  source 1..27: mol_type = other RNA
cagcaaagcggcacctccctgctcaca

SEQ ID NO: 28834 - RNA, 27 nt, synthetic construct
  misc_feature 1..27: note = derived and/or modified sequence opt3 from anti-HIV_CDR
  source 1..27: mol_type = other RNA
atgaagtcccagcacagccccagaacc

SEQ ID NO: 28835 - RNA, 27 nt, synthetic construct
  misc_feature 1..27: note = derived and/or modified sequence opt3 from anti-HIV_CDR
  source 1..27: mol_type = other RNA
atgcagcccctgcaaaccccttacaca

SEQ ID NO: 28836 - RNA, 27 nt, synthetic construct
  misc_feature 1..27: note = derived and/or modified sequence opt3 from anti-HIV_CDR
  source 1..27: mol_type = other RNA
cagcaatacaccgcctatccctggaca

SEQ ID NO: 28837 - RNA, 27 nt, synthetic construct
  misc_feature 1..27: note = derived and/or modified sequence opt3 from anti-HIV_CDR
  source 1..27: mol_type = other RNA
ctgcagaaccacaattaccccagaacc

SEQ ID NO: 28838 - RNA, 27 nt, synthetic construct
  misc_feature 1..27: note = derived and/or modified sequence opt3 from anti-HIV_CDR
  source 1..27: mol_type = other RNA
ctgcagacccacagctaccccagaaca

SEQ ID NO: 28839 - RNA, 30 nt, synthetic construct
  misc_feature 1..30: note = derived and/or modified sequence opt3 from anti-HIV_CDR
  source 1..30: mol_type = other RNA
gccgcttgggacgatagcttcgactacgtg

SEQ ID NO: 28840 - RNA, 30 nt, synthetic construct
  misc_feature 1..30: note = derived and/or modified sequence opt3 from anti-HIV_CDR
  source 1..30: mol_type = other RNA
cagcacagcttcggctcccctccctggacc

SEQ ID NO: 28841 - RNA, 30 nt, synthetic construct
  misc_feature 1..30: note = derived and/or modified sequence opt3 from anti-HIV_CDR
  source 1..30: mol_type = other RNA
agctccttcacccccacaaacactctggtg

SEQ ID NO: 28842 - RNA, 30 nt, synthetic construct
  misc_feature 1..30: note = derived and/or modified sequence opt3 from anti-HIV_CDR
  source 1..30: mol_type = other RNA
cagcaatacggcaccctgcaccccagaaca

SEQ ID NO: 28843 - RNA, 30 nt, synthetic construct
  misc_feature 1..30: note = derived and/or modified sequence opt3 from anti-HIV_CDR
  source 1..30: mol_type = other RNA
cagcaatacaacaattggccccctatcacc

SEQ ID NO: 28844 - RNA, 30 nt, synthetic construct
  misc_feature 1..30: note = derived and/or modified sequence opt3 from anti-HIV_CDR
  source 1..30: mol_type = other RNA
cagcaatactatcagtggctgagctacacc

SEQ ID NO: 28845 - RNA, 30 nt, synthetic construct
  misc_feature 1..30: note = derived and/or modified sequence opt3 from anti-HIV_CDR
  source 1..30: mol_type = other RNA
cagcaaagagccaactggaggctgctcacc

SEQ ID NO: 28846 - RNA, 30 nt, synthetic construct
  misc_feature 1..30: note = derived and/or modified sequence opt3 from anti-HIV_CDR
  source 1..30: mol_type = other RNA
agacacagcgactactgcgatctggacgtg

SEQ ID NO: 28847 - RNA, 30 nt, synthetic construct
  misc_feature 1..30: note = derived and/or modified sequence opt3 from anti-HIV_CDR
  source 1..30: mol_type = other RNA
agaaggagcgactactgcgatttcgacgtg

SEQ ID NO: 28848 - RNA, 30 nt, synthetic construct
  misc_feature 1..30: note = derived and/or modified sequence opt3 from anti-HIV_CDR
  source 1..30: mol_type = other RNA
agacacaccgactactgcgatttcgacgtg

SEQ ID NO: 28849 - RNA, 30 nt, synthetic construct
  misc_feature 1..30: note = derived and/or modified sequence opt3 from anti-HIV_CDR
  source 1..30: mol_type = other RNA
cagagaagcgactactgggatttcgacgtg

SEQ ID NO: 28850 - RNA, 30 nt, synthetic construct
  misc_feature 1..30: note = derived and/or modified sequence opt3 from anti-HIV_CDR
  source 1..30: mol_type = other RNA
agacacagcgactactgcgatttcgacatc

SEQ ID NO: 28851 - RNA, 30 nt, synthetic construct
  misc_feature 1..30: note = derived and/or modified sequence opt3 from anti-HIV_CDR
  source 1..30: mol_type = other RNA
tgcgaggtggacgccgatgaaaccatcaca

SEQ ID NO: 28852 - RNA, 30 nt, synthetic construct
  misc_feature 1..30: note = derived and/or modified sequence opt3 from anti-HIV_CDR
  source 1..30: mol_type = other RNA
tgcgaggtggacgccgaagagaccatcatt

SEQ ID NO: 28853 - RNA, 30 nt, synthetic construct
  misc_feature 1..30: note = derived and/or modified sequence opt3 from anti-HIV_CDR
  source 1..30: mol_type = other RNA
cagagaagcgacttctgggattttgacgtg

SEQ ID NO: 28854 - RNA, 30 nt, synthetic construct
  misc_feature 1..30: note = derived and/or modified sequence opt3 from anti-HIV_CDR
  source 1..30: mol_type = other RNA
agacacagcgactactgcgatttcgacgtg

SEQ ID NO: 28855 - RNA, 30 nt, synthetic construct
  misc_feature 1..30: note = derived and/or modified sequence opt3 from anti-HIV_CDR
  source 1..30: mol_type = other RNA
tgcagctacgccggcgggagaaccgtggtc

SEQ ID NO: 28856 - RNA, 30 nt, synthetic construct
  misc_feature 1..30: note = derived and/or modified sequence opt3 from anti-HIV_CDR
  source 1..30: mol_type = other RNA
gccgcttgggacgatagcctggactacgtg

SEQ ID NO: 28857 - RNA, 30 nt, synthetic construct
  misc_feature 1..30: note = derived and/or modified sequence opt3 from anti-HIV_CDR
  source 1..30: mol_type = other RNA
cagcaaagaagcaactggcccaggctgacc

SEQ ID NO: 28858 - RNA, 30 nt, synthetic construct
  misc_feature 1..30: note = derived and/or modified sequence opt3 from anti-HIV_CDR
  source 1..30: mol_type = other RNA
cagcaatacaacaattggccccctttcacc

SEQ ID NO: 28859 - RNA, 30 nt, synthetic construct
  misc_feature 1..30: note = derived and/or modified sequence opt3 from anti-HIV_CDR
  source 1..30: mol_type = other RNA
atgcagggcacctactggccccctctgaca

SEQ ID NO: 28860 - RNA, 30 nt, synthetic construct
  misc_feature 1..30: note = derived and/or modified sequence opt3 from anti-HIV_CDR
  source 1..30: mol_type = other RNA
cagcaatacggcagctccctgctctatacc

SEQ ID NO: 28861 - RNA, 30 nt, synthetic construct
  misc_feature 1..30: note = derived and/or modified sequence opt3 from anti-HIV_CDR
  source 1..30: mol_type = other RNA
caacagagcttcggcatccctccctggacc

SEQ ID NO: 28862 - RNA, 30 nt, synthetic construct
  misc_feature 1..30: note = derived and/or modified sequence opt3 from anti-HIV_CDR
  source 1..30: mol_type = other RNA
tgcagctacgccggctcctattcttacgtg

SEQ ID NO: 28863 - RNA, 30 nt, synthetic construct
  misc_feature 1..30: note = derived and/or modified sequence opt3 from anti-HIV_CDR
  source 1..30: mol_type = other RNA
tacagctatgccggcaactccctgggggtg

SEQ ID NO: 28864 - RNA, 30 nt, synthetic construct
  misc_feature 1..30: note = derived and/or modified sequence opt3 from anti-HIV_CDR
  source 1..30: mol_type = other RNA
agctcctacaccatctcttcacccagagtg

SEQ ID NO: 28865 - RNA, 30 nt, synthetic construct
  misc_feature 1..30: note = derived and/or modified sequence opt3 from anti-HIV_CDR
  source 1..30: mol_type = other RNA
caggagtgggaactgcaacccttcgactac

SEQ ID NO: 28866 - RNA, 30 nt, synthetic construct; identical to SEQ ID NO: 13582
  misc_feature 1..30: note = derived and/or modified sequence opt3 from anti-HIV_CDR
  source 1..30: mol_type = other RNA

SEQ ID NO: 28867 - RNA, 30 nt, synthetic construct
  misc_feature 1..30: note = derived and/or modified sequence opt3 from anti-HIV_CDR
  source 1..30: mol_type = other RNA
gacagagattacgacgaggatttcgacttt

SEQ ID NO: 28868 - RNA, 30 nt, synthetic construct
  misc_feature 1..30: note = derived and/or modified sequence opt3 from anti-HIV_CDR
  source 1..30: mol_type = other RNA
caggagtacggcagaagccctcccttccca

SEQ ID NO: 28869 - RNA, 30 nt, synthetic construct
  misc_feature 1..30: note = derived and/or modified sequence opt3 from anti-HIV_CDR
  source 1..30: mol_type = other RNA
accctggacggcaacttccactgggatttt

SEQ ID NO: 28870 - RNA, 30 nt, synthetic construct
  misc_feature 1..30: note = derived and/or modified sequence opt3 from anti-HIV_CDR
  source 1..30: mol_type = other RNA
ttcacccagagacaaggcgggtttgactac

SEQ ID NO: 28871 - RNA, 30 nt, synthetic construct
  misc_feature 1..30: note = derived and/or modified sequence opt3 from anti-HIV_CDR
  source 1..30: mol_type = other RNA
cagcaatactataagtggccccctatcacc

SEQ ID NO: 28872 - RNA, 30 nt, synthetic construct
  misc_feature 1..30: note = derived and/or modified sequence opt3 from anti-HIV_CDR
  source 1..30: mol_type = other RNA
cagcaatacggcagctccgccccctatacc

SEQ ID NO: 28873 - RNA, 30 nt, synthetic construct
  misc_feature 1..30: note = derived and/or modified sequence opt3 from anti-HIV_CDR
  source 1..30: mol_type = other RNA
cagcaactgaacagcgaccctccctggacc

SEQ ID NO: 28874 - RNA, 30 nt, synthetic construct
  misc_feature 1..30: note = derived and/or modified sequence opt3 from anti-HIV_CDR
  source 1..30: mol_type = other RNA
cagcaccatggcagctcccccacctggaca

SEQ ID NO: 28875 - RNA, 30 nt, synthetic construct
  misc_feature 1..30: note = derived and/or modified sequence opt3 from anti-HIV_CDR
  source 1..30: mol_type = other RNA
cagcaatacaagaaatggcccccttggacc

SEQ ID NO: 28876 - RNA, 30 nt, synthetic construct
  misc_feature 1..30: note = derived and/or modified sequence opt3 from anti-HIV_CDR
  source 1..30: mol_type = other RNA
cagcaatacggcttcagcctgcccgtgacc

SEQ ID NO: 28877 - RNA, 30 nt, synthetic construct
  misc_feature 1..30: note = derived and/or modified sequence opt3 from anti-HIV_CDR
  source 1..30: mol_type = other RNA
cagagctacaacggcgaccctcccgtgacc

SEQ ID NO: 28878 - RNA, 30 nt, synthetic construct
  misc_feature 1..30: note = derived and/or modified sequence opt3 from anti-HIV_CDR
  source 1..30: mol_type = other RNA
cagcaatacggcagctccagaaggtggacc

SEQ ID NO: 28879 - RNA, 30 nt, synthetic construct
  misc_feature 1..30: note = derived and/or modified sequence opt3 from anti-HIV_CDR
  source 1..30: mol_type = other RNA
cagcaattcaacagctaccctcccctgacc

SEQ ID NO: 28880 - RNA, 30 nt, synthetic construct
  misc_feature 1..30: note = derived and/or modified sequence opt3 from anti-HIV_CDR
  source 1..30: mol_type = other RNA
agagagggcagccagggggccttcgacatc

SEQ ID NO: 28881 - RNA, 30 nt, synthetic construct
  misc_feature 1..30: note = derived and/or modified sequence opt3 from anti-HIV_CDR
  source 1..30: mol_type = other RNA
ggcgacagcgggcccaccggattcgattac

SEQ ID NO: 28882 - RNA, 30 nt, synthetic construct
  misc_feature 1..30: note = derived and/or modified sequence opt3 from anti-HIV_CDR
  source 1..30: mol_type = other RNA
gtgagaaggggcagctcctaccccgactat

SEQ ID NO: 28883 - RNA, 30 nt, synthetic construct
  misc_feature 1..30: note = derived and/or modified sequence opt3 from anti-HIV_CDR
  source 1..30: mol_type = other RNA
agcgcctactatagaaactggttcgactcc

SEQ ID NO: 28884 - RNA, 30 nt, synthetic construct
  misc_feature 1..30: note = derived and/or modified sequence opt3 from anti-HIV_CDR
  source 1..30: mol_type = other RNA
cagagctacgactcctctgtgtcagtcgtt

SEQ ID NO: 28885 - RNA, 30 nt, synthetic construct
  misc_feature 1..30: note = derived and/or modified sequence opt3 from anti-HIV_CDR
  source 1..30: mol_type = other RNA
agctcctacacctcttcactgacactcgtg

SEQ ID NO: 28886 - RNA, 30 nt, synthetic construct
  misc_feature 1..30: note = derived and/or modified sequence opt3 from anti-HIV_CDR
  source 1..30: mol_type = other RNA
tacgagggcaagagaagcgggatggacgtg

SEQ ID NO: 28887 - RNA, 30 nt, synthetic construct
  misc_feature 1..30: note = derived and/or modified sequence opt3 from anti-HIV_CDR
  source 1..30: mol_type = other RNA
cagcaatacggcagctcccccgagtatacc

SEQ ID NO: 28888 - RNA, 30 nt, synthetic construct
  misc_feature 1..30: note = derived and/or modified sequence opt3 from anti-HIV_CDR
  source 1..30: mol_type = other RNA
cagtactatgaccacagacccgccatcgct

SEQ ID NO: 28889 - RNA, 30 nt, synthetic construct
  misc_feature 1..30: note = derived and/or modified sequence opt3 from anti-HIV_CDR
  source 1..30: mol_type = other RNA
cagcaatacgacaacctgcccagagtgacc

SEQ ID NO: 28890 - RNA, 30 nt, synthetic construct
  misc_feature 1..30: note = derived and/or modified sequence opt3 from anti-HIV_CDR
  source 1..30: mol_type = other RNA
ggcgcctacaccacaactagcacgctggtg

SEQ ID NO: 28891 - RNA, 30 nt, synthetic construct
  misc_feature 1..30: note = derived and/or modified sequence opt3 from anti-HIV_CDR
  source 1..30: mol_type = other RNA
cagcaatacaagtcctatagccccctgacc

SEQ ID NO: 28892 - RNA, 30 nt, synthetic construct
  misc_feature 1..30: note = derived and/or modified sequence opt3 from anti-HIV_CDR
  source 1..30: mol_type = other RNA
cagcaaagctacaacaccagacccctgaca

SEQ ID NO: 28893 - RNA, 30 nt, synthetic construct
  misc_feature 1..30: note = derived and/or modified sequence opt3 from anti-HIV_CDR
  source 1..30: mol_type = other RNA
cagcaatacggcgggagccctcccgacacc

SEQ ID NO: 28894 - RNA, 30 nt, synthetic construct
  misc_feature 1..30: note = derived and/or modified sequence opt3 from anti-HIV_CDR
  source 1..30: mol_type = other RNA
tgcagctacacctcctctgccacagtggtc

SEQ ID NO: 28895 - RNA, 30 nt, synthetic construct
  misc_feature 1..30: note = derived and/or modified sequence opt3 from anti-HIV_CDR
  source 1..30: mol_type = other RNA
tgcagccacacctcctctgacacactggtg

SEQ ID NO: 28896 - RNA, 30 nt, synthetic construct
  misc_feature 1..30: note = derived and/or modified sequence opt3 from anti-HIV_CDR
  source 1..30: mol_type = other RNA
cagcactacggcaacagccccagagtgacc

SEQ ID NO: 28897 - RNA, 30 nt, synthetic construct
  misc_feature 1..30: note = derived and/or modified sequence opt3 from anti-HIV_CDR
  source 1..30: mol_type = other RNA
gacgccttcgtgagctccgctatggatgtc

SEQ ID NO: 28898 - RNA, 30 nt, synthetic construct
  misc_feature 1..30: note = derived and/or modified sequence opt3 from anti-HIV_CDR
  source 1..30: mol_type = other RNA
ctgagagccaccacacccggcttcgactac

SEQ ID NO: 28899 - RNA, 30 nt, synthetic construct
  misc_feature 1..30: note = derived and/or modified sequence opt3 from anti-HIV_CDR
  source 1..30: mol_type = other RNA
ctgagagccaccatccccggcttcgactac

SEQ ID NO: 28900 - RNA, 30 nt, synthetic construct
  misc_feature 1..30: note = derived and/or modified sequence opt3 from anti-HIV_CDR
  source 1..30: mol_type = other RNA
ctgagagccaccatcgctggcttcgactac

SEQ ID NO: 28901 - RNA, 30 nt, synthetic construct
  misc_feature 1..30: note = derived and/or modified sequence opt3 from anti-HIV_CDR
  source 1..30: mol_type = other RNA
tgcagctacgccggctcctatatctgggtg

SEQ ID NO: 28902 - RNA, 30 nt, synthetic construct
  misc_feature 1..30: note = derived and/or modified sequence opt3 from anti-HIV_CDR
  source 1..30: mol_type = other RNA
tgcagctacgccggcacctattcctacgtg

SEQ ID NO: 28903 - RNA, 30 nt, synthetic construct
  misc_feature 1..30: note = derived and/or modified sequence opt3 from anti-HIV_CDR
  source 1..30: mol_type = other RNA
agctcctacgccggctctaacaatttcgtg

SEQ ID NO: 28904 - RNA, 30 nt, synthetic construct
  misc_feature 1..30: note = derived and/or modified sequence opt3 from anti-HIV_CDR
  source 1..30: mol_type = other RNA
ggcagcttcaccacatccctgactctcgtg

SEQ ID NO: 28905 - RNA, 30 nt, synthetic construct
  misc_feature 1..30: note = derived and/or modified sequence opt3 from anti-HIV_CDR
  source 1..30: mol_type = other RNA
cagcaatacgccaccagctccctgtataca

SEQ ID NO: 28906 - RNA, 30 nt, synthetic construct
  misc_feature 1..30: note = derived and/or modified sequence opt3 from anti-HIV_CDR
  source 1..30: mol_type = other RNA
cagtggtacggcaccctgcaccccagaaca

SEQ ID NO: 28907 - RNA, 30 nt, synthetic construct
  misc_feature 1..30: note = derived and/or modified sequence opt3 from anti-HIV_CDR
  source 1..30: mol_type = other RNA
agctcctactcttcaaccaacacatatgtg

SEQ ID NO: 28908 - RNA, 30 nt, synthetic construct
  misc_feature 1..30: note = derived and/or modified sequence opt3 from anti-HIV_CDR
  source 1..30: mol_type = other RNA
accttcatcacagccagctggtttgactcc

SEQ ID NO: 28909 - RNA, 30 nt, synthetic construct
  misc_feature 1..30: note = derived and/or modified sequence opt3 from anti-HIV_CDR
  source 1..30: mol_type = other RNA
accggcgggctgctcagattccccgaggtg

SEQ ID NO: 28910 - RNA, 30 nt, synthetic construct
  misc_feature 1..30: note = derived and/or modified sequence opt3 from anti-HIV_CDR
  source 1..30: mol_type = other RNA
tgcagctacgccggctcctatacctacgtg

SEQ ID NO: 28911 - RNA, 30 nt, synthetic construct
  misc_feature 1..30: note = derived and/or modified sequence opt3 from anti-HIV_CDR
  source 1..30: mol_type = other RNA
cagcaaagatacagctggccctccctgacc

SEQ ID NO: 28912 - RNA, 30 nt, synthetic construct
  misc_feature 1..30: note = derived and/or modified sequence opt3 from anti-HIV_CDR
  source 1..30: mol_type = other RNA
ctgcagtgcggcagctcccctccctacacc

SEQ ID NO: 28913 - RNA, 30 nt, synthetic construct; identical to SEQ ID NO: 13629
  misc_feature 1..30: note = derived and/or modified sequence opt3 from anti-HIV_CDR
  source 1..30: mol_type = other RNA

SEQ ID NO: 28914 - RNA, 30 nt, synthetic construct
  misc_feature 1..30: note = derived and/or modified sequence opt3 from anti-HIV_CDR
  source 1..30: mol_type = other RNA
agctcctacgccgctaccaaccactgggtg

SEQ ID NO: 28915 - RNA, 30 nt, synthetic construct
  misc_feature 1..30: note = derived and/or modified sequence opt3 from anti-HIV_CDR
  source 1..30: mol_type = other RNA
cagtactatggcaccagccctccctccaca

SEQ ID NO: 28916 - RNA, 30 nt, synthetic construct
  misc_feature 1..30: note = derived and/or modified sequence opt3 from anti-HIV_CDR
  source 1..30: mol_type = other RNA
cagtactatggcagctctcccccttccacc

SEQ ID NO: 28917 - RNA, 30 nt, synthetic construct
  misc_feature 1..30: note = derived and/or modified sequence opt3 from anti-HIV_CDR
  source 1..30: mol_type = other RNA
caggagttcggcagagcccctccctaccca

SEQ ID NO: 28918 - RNA, 30 nt, synthetic construct
  misc_feature 1..30: note = derived and/or modified sequence opt3 from anti-HIV_CDR
  source 1..30: mol_type = other RNA
caggagtacggcagaagccctccctatcca

SEQ ID NO: 28919 - RNA, 30 nt, synthetic construct
  misc_feature 1..30: note = derived and/or modified sequence opt3 from anti-HIV_CDR
  source 1..30: mol_type = other RNA
caggagtacggcagagcccctccctatcca

SEQ ID NO: 28920 - RNA, 30 nt, synthetic construct
  misc_feature 1..30: note = derived and/or modified sequence opt3 from anti-HIV_CDR
  source 1..30: mol_type = other RNA
cacatcgccgtgggcgggagcgaggaacat

SEQ ID NO: 28921 - RNA, 30 nt, synthetic construct
  misc_feature 1..30: note = derived and/or modified sequence opt3 from anti-HIV_CDR
  source 1..30: mol_type = other RNA
cacatcgccgtgggcgggagcgaggaccat

SEQ ID NO: 28922 - RNA, 30 nt, synthetic construct
  misc_feature 1..30: note = derived and/or modified sequence opt3 from anti-HIV_CDR
  source 1..30: mol_type = other RNA
cacatcgccgtgggcgggagagaggaagag

SEQ ID NO: 28923 - RNA, 33 nt, synthetic construct
  misc_feature 1..33: note = derived and/or modified sequence opt3 from anti-HIV_CDR
  source 1..33: mol_type = other RNA
ggcgagaagtccagagggagcagggccgtgcag

SEQ ID NO: 28924 - RNA, 33 nt, synthetic construct
  misc_feature 1..33: note = derived and/or modified sequence opt3 from anti-HIV_CDR
  source 1..33: mol_type = other RNA
ggcgagaagtccttcgccagcagagctgtgcag

SEQ ID NO: 28925 - RNA, 33 nt, synthetic construct
  misc_feature 1..33: note = derived and/or modified sequence opt3 from anti-HIV_CDR
  source 1..33: mol_type = other RNA
ggcagacaggccctggggagcagggctgtgcaa

SEQ ID NO: 28926 - RNA, 33 nt, synthetic construct
  misc_feature 1..33: note = derived and/or modified sequence opt3 from anti-HIV_CDR
  source 1..33: mol_type = other RNA
ggcgaggaaagcctggggtccagatctgtgatc

SEQ ID NO: 28927 - RNA, 33 nt, synthetic construct
  misc_feature 1..33: note = derived and/or modified sequence opt3 from anti-HIV_CDR
  source 1..33: mol_type = other RNA
ggcgagaagtccctggggagcagagccgtgcag

SEQ ID NO: 28928 - RNA, 33 nt, synthetic construct
  misc_feature 1..33: note = derived and/or modified sequence opt3 from anti-HIV_CDR
  source 1..33: mol_type = other RNA
ggcaaggagagcatcgggtccagagccgtgcag

SEQ ID NO: 28929 - RNA, 33 nt, synthetic construct
  misc_feature 1..33: note = derived and/or modified sequence opt3 from anti-HIV_CDR
  source 1..33: mol_type = other RNA
ggcgggaacaatatcggaagcaagtccgtgcac

SEQ ID NO: 28930 - RNA, 33 nt, synthetic construct
  misc_feature 1..33: note = derived and/or modified sequence opt3 from anti-HIV_CDR
  source 1..33: mol_type = other RNA
ggcgagaagtccatcgggagcagagccgtgcag

SEQ ID NO: 28931 - RNA, 33 nt, synthetic construct
  misc_feature 1..33: note = derived and/or modified sequence opt3 from anti-HIV_CDR
  source 1..33: mol_type = other RNA
aaggccagccaggacgtgtccaccgctgtcgca

SEQ ID NO: 28932 - RNA, 33 nt, synthetic construct
  misc_feature 1..33: note = derived and/or modified sequence opt3 from anti-HIV_CDR
  source 1..33: mol_type = other RNA
ggcagcagaaacctgtcccacaggctcctttct

SEQ ID NO: 28933 - RNA, 33 nt, synthetic construct
  misc_feature 1..33: note = derived and/or modified sequence opt3 from anti-HIV_CDR
  source 1..33: mol_type = other RNA
ggcacctacgacagccaggggtccacaagactg

SEQ ID NO: 28934 - RNA, 33 nt, synthetic construct
  misc_feature 1..33: note = derived and/or modified sequence opt3 from anti-HIV_CDR
  source 1..33: mol_type = other RNA
cagcaaagaaccatctggccccctggctgcagc

SEQ ID NO: 28935 - RNA, 33 nt, synthetic construct
  misc_feature 1..33: note = derived and/or modified sequence opt3 from anti-HIV_CDR
  source 1..33: mol_type = other RNA
ggcacctgggacagctccctgtctgccgtgctc

SEQ ID NO: 28936 - RNA, 33 nt, synthetic construct
  misc_feature 1..33: note = derived and/or modified sequence opt3 from anti-HIV_CDR
  source 1..33: mol_type = other RNA
gccagctgggacaactccctgtctggccccgtg

SEQ ID NO: 28937 - RNA, 33 nt, synthetic construct
  misc_feature 1..33: note = derived and/or modified sequence opt3 from anti-HIV_CDR
  source 1..33: mol_type = other RNA
gccagctgggacgattccctgtctggctgggtg

SEQ ID NO: 28938 - RNA, 33 nt, synthetic construct
  misc_feature 1..33: note = derived and/or modified sequence opt3 from anti-HIV_CDR
  source 1..33: mol_type = other RNA
ctgctccttccctactatggcgggccttggatc

SEQ ID NO: 28939 - RNA, 33 nt, synthetic construct
  misc_feature 1..33: note = derived and/or modified sequence opt3 from anti-HIV_CDR
  source 1..33: mol_type = other RNA
cagcacagaaccaactggccccctagcatcaca

SEQ ID NO: 28940 - RNA, 33 nt, synthetic construct
  misc_feature 1..33: note = derived and/or modified sequence opt3 from anti-HIV_CDR
  source 1..33: mol_type = other RNA
cagagctacgacagatccctgaggggctctgtg

SEQ ID NO: 28941 - RNA, 33 nt, synthetic construct
  misc_feature 1..33: note = derived and/or modified sequence opt3 from anti-HIV_CDR
  source 1..33: mol_type = other RNA
agctccggcaactacgacttcgcctttgatatc

SEQ ID NO: 28942 - RNA, 33 nt, synthetic construct
  misc_feature 1..33: note = derived and/or modified sequence opt3 from anti-HIV_CDR
  source 1..33: mol_type = other RNA
agctccggcaactacgacttcgcctatgatatc

SEQ ID NO: 28943 - RNA, 33 nt, synthetic construct
  misc_feature 1..33: note = derived and/or modified sequence opt3 from anti-HIV_CDR
  source 1..33: mol_type = other RNA
agctccggcaacttcgagtttgccttcgaaatc

SEQ ID NO: 28944 - RNA, 33 nt, synthetic construct
  misc_feature 1..33: note = derived and/or modified sequence opt3 from anti-HIV_CDR
  source 1..33: mol_type = other RNA
gccacctacgacagccacggctccatcagactg

SEQ ID NO: 28945 - RNA, 33 nt, synthetic construct
  misc_feature 1..33: note = derived and/or modified sequence opt3 from anti-HIV_CDR
  source 1..33: mol_type = other RNA
ggcacctacgacacaagcctgtccctcagactt

SEQ ID NO: 28946 - RNA, 33 nt, synthetic construct
  misc_feature 1..33: note = derived and/or modified sequence opt3 from anti-HIV_CDR
  source 1..33: mol_type = other RNA
gccgctttcgacagcgcactgtccctccccctt

SEQ ID NO: 28947 - RNA, 33 nt, synthetic construct
  misc_feature 1..33: note = derived and/or modified sequence opt3 from anti-HIV_CDR
  source 1..33: mol_type = other RNA
gccacctacgacagcgatggctccatcagactg

SEQ ID NO: 28948 - RNA, 33 nt, synthetic construct
  misc_feature 1..33: note = derived and/or modified sequence opt3 from anti-HIV_CDR
  source 1..33: mol_type = other RNA
gccacctacgacagcggctggtccatcagactg

SEQ ID NO: 28949 - RNA, 33 nt, synthetic construct
  misc_feature 1..33: note = derived and/or modified sequence opt3 from anti-HIV_CDR
  source 1..33: mol_type = other RNA
gccacctacgacacaggcctgagcctcagactt

SEQ ID NO: 28950 - RNA, 33 nt, synthetic construct
  misc_feature 1..33: note = derived and/or modified sequence opt3 from anti-HIV_CDR
  source 1..33: mol_type = other RNA
gccgcttacgacagcaccctgtccctcagactt

SEQ ID NO: 28951 - RNA, 33 nt, synthetic construct
  misc_feature 1..33: note = derived and/or modified sequence opt3 from anti-HIV_CDR
  source 1..33: mol_type = other RNA
gccgcttacgacagcgcagtgtccctgcccgtc

SEQ ID NO: 28952 - RNA, 33 nt, synthetic construct
  misc_feature 1..33: note = derived and/or modified sequence opt3 from anti-HIV_CDR
  source 1..33: mol_type = other RNA
gccacctacgacacagatctgagcctcagactt

SEQ ID NO: 28953 - RNA, 33 nt, synthetic construct
  misc_feature 1..33: note = derived and/or modified sequence opt3 from anti-HIV_CDR
  source 1..33: mol_type = other RNA
gccgcttacgacagctccctgtctctcagactt

SEQ ID NO: 28954 - RNA, 33 nt, synthetic construct
  misc_feature 1..33: note = derived and/or modified sequence opt3 from anti-HIV_CDR
  source 1..33: mol_type = other RNA
gccgcttacgacagcaccttctccctgcccgtg

SEQ ID NO: 28955 - RNA, 33 nt, synthetic construct
  misc_feature 1..33: note = derived and/or modified sequence opt3 from anti-HIV_CDR
  source 1..33: mol_type = other RNA
gccacctacgacagccagggctccacaagactg

SEQ ID NO: 28956 - RNA, 33 nt, synthetic construct
  misc_feature 1..33: note = derived and/or modified sequence opt3 from anti-HIV_CDR
  source 1..33: mol_type = other RNA
gccacctacgacagccagagatccatcaggctg

SEQ ID NO: 28957 - RNA, 33 nt, synthetic construct
  misc_feature 1..33: note = derived and/or modified sequence opt3 from anti-HIV_CDR
  source 1..33: mol_type = other RNA
gccgtgtacgacagctccctgtctctcggcctt

SEQ ID NO: 28958 - RNA, 33 nt, synthetic construct
  misc_feature 1..33: note = derived and/or modified sequence opt3 from anti-HIV_CDR
  source 1..33: mol_type = other RNA
cagcacagaagcatctggcccctgatgtgcacc

SEQ ID NO: 28959 - RNA, 33 nt, synthetic construct
  misc_feature 1..33: note = derived and/or modified sequence opt3 from anti-HIV_CDR
  source 1..33: mol_type = other RNA
ctgcagcccgtgtacatcttcagaggcacctgg

SEQ ID NO: 28960 - RNA, 33 nt, synthetic construct
  misc_feature 1..33: note = derived and/or modified sequence opt3 from anti-HIV_CDR
  source 1..33: mol_type = other RNA
tgcgaggtggacgccgatgaaaccgtcacatgt

SEQ ID NO: 28961 - RNA, 33 nt, synthetic construct
  misc_feature 1..33: note = derived and/or modified sequence opt3 from anti-HIV_CDR
  source 1..33: mol_type = other RNA
tgcgaggtggacgccgaagtcaccatgacagtt

SEQ ID NO: 28962 - RNA, 33 nt, synthetic construct
  misc_feature 1..33: note = derived and/or modified sequence opt3 from anti-HIV_CDR
  source 1..33: mol_type = other RNA
agctcctacgccgacaccaacgatttcggcgtg

SEQ ID NO: 28963 - RNA, 33 nt, synthetic construct
  misc_feature 1..33: note = derived and/or modified sequence opt3 from anti-HIV_CDR
  source 1..33: mol_type = other RNA
tgcagcttcacctacgtgaaccccacatatctg

SEQ ID NO: 28964 - RNA, 33 nt, synthetic construct
  misc_feature 1..33: note = derived and/or modified sequence opt3 from anti-HIV_CDR
  source 1..33: mol_type = other RNA
ggcacctgggacgggagcctgacaactggagtg

SEQ ID NO: 28965 - RNA, 33 nt, synthetic construct
  misc_feature 1..33: note = derived and/or modified sequence opt3 from anti-HIV_CDR
  source 1..33: mol_type = other RNA
cagagctacgacaactccctgtctggctgggtg

SEQ ID NO: 28966 - RNA, 33 nt, synthetic construct
  misc_feature 1..33: note = derived and/or modified sequence opt3 from anti-HIV_CDR
  source 1..33: mol_type = other RNA
cagcaatactatagcatccctccctggaccttc

SEQ ID NO: 28967 - RNA, 33 nt, synthetic construct
  misc_feature 1..33: note = derived and/or modified sequence opt3 from anti-HIV_CDR
  source 1..33: mol_type = other RNA
atgcagggcacctactggccccctagcatcaca

SEQ ID NO: 28968 - RNA, 33 nt, synthetic construct
  misc_feature 1..33: note = derived and/or modified sequence opt3 from anti-HIV_CDR
  source 1..33: mol_type = other RNA
cagagctacgactcctctctgggcgtggaggtc

SEQ ID NO: 28969 - RNA, 33 nt, synthetic construct
  misc_feature 1..33: note = derived and/or modified sequence opt3 from anti-HIV_CDR
  source 1..33: mol_type = other RNA
caggtgtgggacagcggcagagattcctgggtc

SEQ ID NO: 28970 - RNA, 33 nt, synthetic construct
  misc_feature 1..33: note = derived and/or modified sequence opt3 from anti-HIV_CDR
  source 1..33: mol_type = other RNA
cagagctacgactcctctctgtcaggctgggtg

SEQ ID NO: 28971 - RNA, 33 nt, synthetic construct
  misc_feature 1..33: note = derived and/or modified sequence opt3 from anti-HIV_CDR
  source 1..33: mol_type = other RNA
ggcagctgggacgggtccctgaacgccggagtg

SEQ ID NO: 28972 - RNA, 33 nt, synthetic construct
  misc_feature 1..33: note = derived and/or modified sequence opt3 from anti-HIV_CDR
  source 1..33: mol_type = other RNA
ctgagcgccgactcctcttcaacctaccaggtg

SEQ ID NO: 28973 - RNA, 33 nt, synthetic construct
  misc_feature 1..33: note = derived and/or modified sequence opt3 from anti-HIV_CDR
  source 1..33: mol_type = other RNA
tgcagctacgccggcagagacacctcctgggtg

SEQ ID NO: 28974 - RNA, 33 nt, synthetic construct
  misc_feature 1..33: note = derived and/or modified sequence opt3 from anti-HIV_CDR
  source 1..33: mol_type = other RNA
cagcaaagaagcaactggccccctggcctgacc

SEQ ID NO: 28975 - RNA, 33 nt, synthetic construct
  misc_feature 1..33: note = derived and/or modified sequence opt3 from anti-HIV_CDR
  source 1..33: mol_type = other RNA
aagggcagagggtacggatattggttcgacagc

SEQ ID NO: 28976 - RNA, 33 nt, synthetic construct
  misc_feature 1..33: note = derived and/or modified sequence opt3 from anti-HIV_CDR
  source 1..33: mol_type = other RNA
gagatggccgctaccagcgacgcattcgatatc

SEQ ID NO: 28977 - RNA, 33 nt, synthetic construct
  misc_feature 1..33: note = derived and/or modified sequence opt3 from anti-HIV_CDR
  source 1..33: mol_type = other RNA
agcatctactccaccggccccgcccctgtgtat

SEQ ID NO: 28978 - RNA, 33 nt, synthetic construct
  misc_feature 1..33: note = derived and/or modified sequence opt3 from anti-HIV_CDR
  source 1..33: mol_type = other RNA
agaggcagcctgctcatcaagtacttcgactat

SEQ ID NO: 28979 - RNA, 33 nt, synthetic construct
  misc_feature 1..33: note = derived and/or modified sequence opt3 from anti-HIV_CDR
  source 1..33: mol_type = other RNA
cagcaatacgacaacctgccccctagagtgacc

SEQ ID NO: 28980 - RNA, 33 nt, synthetic construct
  misc_feature 1..33: note = derived and/or modified sequence opt3 from anti-HIV_CDR
  source 1..33: mol_type = other RNA
gacgtgagactggtcgccgttcccggcgctgat

SEQ ID NO: 28981 - RNA, 33 nt, synthetic construct
  misc_feature 1..33: note = derived and/or modified sequence opt3 from anti-HIV_CDR
  source 1..33: mol_type = other RNA
cagcaaagaaccacatggccccctgagtacact

SEQ ID NO: 28982 - RNA, 33 nt, synthetic construct
  misc_feature 1..33: note = derived and/or modified sequence opt3 from anti-HIV_CDR
  source 1..33: mol_type = other RNA
gccgcttgggacgatagcctgaacggctgggtg

SEQ ID NO: 28983 - RNA, 33 nt, synthetic construct
  misc_feature 1..33: note = derived and/or modified sequence opt3 from anti-HIV_CDR
  source 1..33: mol_type = other RNA
agaaggcggagcgcctggtcccccttcgactct

SEQ ID NO: 28984 - RNA, 33 nt, synthetic construct
  misc_feature 1..33: note = derived and/or modified sequence opt3 from anti-HIV_CDR
  source 1..33: mol_type = other RNA
gccacctgggacagctccctgagaacagctctc

SEQ ID NO: 28985 - RNA, 33 nt, synthetic construct
  misc_feature 1..33: note = derived and/or modified sequence opt3 from anti-HIV_CDR
  source 1..33: mol_type = other RNA
ggcacctgggacagctccctgagagccgctctc

SEQ ID NO: 28986 - RNA, 33 nt, synthetic construct
  misc_feature 1..33: note = derived and/or modified sequence opt3 from anti-HIV_CDR
  source 1..33: mol_type = other RNA
cagcaaagaagcatctggcccccttccctgacc

SEQ ID NO: 28987 - RNA, 33 nt, synthetic construct
  misc_feature 1..33: note = derived and/or modified sequence opt3 from anti-HIV_CDR
  source 1..33: mol_type = other RNA
gagttccagaccagcggcgtggtcagagaaggg

SEQ ID NO: 28988 - RNA, 33 nt, synthetic construct
  misc_feature 1..33: note = derived and/or modified sequence opt3 from anti-HIV_CDR
  source 1..33: mol_type = other RNA
cacatcggcgccgggggaccctacagcgagtat

SEQ ID NO: 28989 - RNA, 33 nt, synthetic construct
  misc_feature 1..33: note = derived and/or modified sequence opt3 from anti-HIV_CDR
  source 1..33: mol_type = other RNA
agaggccacagcttcacctccccctttgactct

SEQ ID NO: 28990 - RNA, 33 nt, synthetic construct
  misc_feature 1..33: note = derived and/or modified sequence opt3 from anti-HIV_CDR
  source 1..33: mol_type = other RNA
cagcacctgaacagctaccccagaatgtatacc

SEQ ID NO: 28991 - RNA, 33 nt, synthetic construct
  misc_feature 1..33: note = derived and/or modified sequence opt3 from anti-HIV_CDR
  source 1..33: mol_type = other RNA
cagcaaagaagcaactggccccctaagatcacc

SEQ ID NO: 28992 - RNA, 33 nt, synthetic construct
  misc_feature 1..33: note = derived and/or modified sequence opt3 from anti-HIV_CDR
  source 1..33: mol_type = other RNA
gccgcttgggacgatagcctgggcggggtggtc

SEQ ID NO: 28993 - RNA, 33 nt, synthetic construct
  misc_feature 1..33: note = derived and/or modified sequence opt3 from anti-HIV_CDR
  source 1..33: mol_type = other RNA
ggcacctgggacagctccctgtctgccgtggtc

SEQ ID NO: 28994 - RNA, 33 nt, synthetic construct
  misc_feature 1..33: note = derived and/or modified sequence opt3 from anti-HIV_CDR
  source 1..33: mol_type = other RNA
cagcaaagagccaactggccccctggcgggacc

SEQ ID NO: 28995 - RNA, 33 nt, synthetic construct
  misc_feature 1..33: note = derived and/or modified sequence opt3 from anti-HIV_CDR
  source 1..33: mol_type = other RNA
ggcgggggataccccagaggtaacatggacgtg

SEQ ID NO: 28996 - RNA, 33 nt, synthetic construct
  misc_feature 1..33: note = derived and/or modified sequence opt3 from anti-HIV_CDR
  source 1..33: mol_type = other RNA
ctgctccttctgtactatggcgggccctggatc

SEQ ID NO: 28997 - RNA, 33 nt, synthetic construct
  misc_feature 1..33: note = derived and/or modified sequence opt3 from anti-HIV_CDR
  source 1..33: mol_type = other RNA
cagcaaagaggcatctggcccctgcagattacc

SEQ ID NO: 28998 - RNA, 33 nt, synthetic construct
  misc_feature 1..33: note = derived and/or modified sequence opt3 from anti-HIV_CDR
  source 1..33: mol_type = other RNA
agaagccccggcgggggatacgccttcgacatc

SEQ ID NO: 28999 - RNA, 33 nt, synthetic construct
  misc_feature 1..33: note = derived and/or modified sequence opt3 from anti-HIV_CDR
  source 1..33: mol_type = other RNA
agcggccccgggctgctcagaggattcgactac

SEQ ID NO: 29000 - RNA, 33 nt, synthetic construct
  misc_feature 1..33: note = derived and/or modified sequence opt3 from anti-HIV_CDR
  source 1..33: mol_type = other RNA
cagcaaagaaccacaaggccccctgagtacact

SEQ ID NO: 29001 - RNA, 33 nt, synthetic construct
  misc_feature 1..33: note = derived and/or modified sequence opt3 from anti-HIV_CDR
  source 1..33: mol_type = other RNA
cagcaaagaaccacaaggccccctgactacact

SEQ ID NO: 29002 - RNA, 33 nt, synthetic construct
  misc_feature 1..33: note = derived and/or modified sequence opt3 from anti-HIV_CDR
  source 1..33: mol_type = other RNA
cagggcagaaccacaaggccccctgactacact

SEQ ID NO: 29003 - RNA, 33 nt, synthetic construct
  misc_feature 1..33: note = derived and/or modified sequence opt3 from anti-HIV_CDR
  source 1..33: mol_type = other RNA
cagcaaagaagcaccacaccccctgagtacact

SEQ ID NO: 29004 - RNA, 33 nt, synthetic construct
  misc_feature 1..33: note = derived and/or modified sequence opt3 from anti-HIV_CDR
  source 1..33: mol_type = other RNA
cagcaaagaaccagctggcccctggccctctcc

SEQ ID NO: 29005 - RNA, 33 nt, synthetic construct
  misc_feature 1..33: note = derived and/or modified sequence opt3 from anti-HIV_CDR
  source 1..33: mol_type = other RNA
agaggccacagcttctccctgccctttgactct

SEQ ID NO: 29006 - RNA, 36 nt, synthetic construct
  misc_feature 1..36: note = derived and/or modified sequence opt3 from anti-HIV_CDR
  source 1..36: mol_type = other RNA
cactactgggacagcagatcccccatctcttgggtg

SEQ ID NO: 29007 - RNA, 36 nt, synthetic construct
  misc_feature 1..36: note = derived and/or modified sequence opt3 from anti-HIV_CDR
  source 1..36: mol_type = other RNA
cacaagtgggacagcagatctcccctgtcctgggtg

SEQ ID NO: 29008 - RNA, 36 nt, synthetic construct
  misc_feature 1..36: note = derived and/or modified sequence opt3 from anti-HIV_CDR
  source 1..36: mol_type = other RNA
cacatgtgggacagcagatccggcttctcttggtca

SEQ ID NO: 29009 - RNA, 36 nt, synthetic construct
  misc_feature 1..36: note = derived and/or modified sequence opt3 from anti-HIV_CDR
  source 1..36: mol_type = other RNA
cacatctgggacagcagagtgcccaccaagtgggtc

SEQ ID NO: 29010 - RNA, 36 nt, synthetic construct
  misc_feature 1..36: note = derived and/or modified sequence opt3 from anti-HIV_CDR
  source 1..36: mol_type = other RNA
caggtgtgggacagctcctctgatcacccctgggtc

SEQ ID NO: 29011 - RNA, 36 nt, synthetic construct
  misc_feature 1..36: note = derived and/or modified sequence opt3 from anti-HIV_CDR
  source 1..36: mol_type = other RNA
cacatctacgacgccagaaggcccaccaactgggtg

SEQ ID NO: 29012 - RNA, 36 nt, synthetic construct
  misc_feature 1..36: note = derived and/or modified sequence opt3 from anti-HIV_CDR
  source 1..36: mol_type = other RNA
ctggacggcgaggccttcagatactatctcgatctt

SEQ ID NO: 29013 - RNA, 36 nt, synthetic construct
  misc_feature 1..36: note = derived and/or modified sequence opt3 from anti-HIV_CDR
  source 1..36: mol_type = other RNA
ccccagtacaacctgggcagagaccctctcgatgtg

SEQ ID NO: 29014 - RNA, 36 nt, synthetic construct
  misc_feature 1..36: note = derived and/or modified sequence opt3 from anti-HIV_CDR
  source 1..36: mol_type = other RNA
cccgagcctagctccatcgtggccccactgtactat

SEQ ID NO: 29015 - RNA, 36 nt, synthetic construct
  misc_feature 1..36: note = derived and/or modified sequence opt3 from anti-HIV_CDR
  source 1..36: mol_type = other RNA
ggcgggggagacggtagaaactggcatctgcacccc

SEQ ID NO: 29016 - RNA, 36 nt, synthetic construct
  misc_feature 1..36: note = derived and/or modified sequence opt3 from anti-HIV_CDR
  source 1..36: mol_type = other RNA
cccaagagcggcagagactactggtccttcgatctg

SEQ ID NO: 29017 - RNA, 36 nt, synthetic construct
  misc_feature 1..36: note = derived and/or modified sequence opt3 from anti-HIV_CDR
  source 1..36: mol_type = other RNA
cccagaggcgggagggacaactggagcttccacgtg

SEQ ID NO: 29018 - RNA, 36 nt, synthetic construct
  misc_feature 1..36: note = derived and/or modified sequence opt3 from anti-HIV_CDR
  source 1..36: mol_type = other RNA
ccccacagccctgacgatgcctggtccctggacgtg

SEQ ID NO: 29019 - RNA, 36 nt, synthetic construct
  misc_feature 1..36: note = derived and/or modified sequence opt3 from anti-HIV_CDR
  source 1..36: mol_type = other RNA
cccctgagaggcggggacacctggcactaccatagc

SEQ ID NO: 29020 - RNA, 36 nt, synthetic construct
  misc_feature 1..36: note = derived and/or modified sequence opt3 from anti-HIV_CDR
  source 1..36: mol_type = other RNA
ctgcagcccgtgtacatcctcagaagcatttgccac

SEQ ID NO: 29021 - RNA, 36 nt, synthetic construct
  misc_feature 1..36: note = derived and/or modified sequence opt3 from anti-HIV_CDR
  source 1..36: mol_type = other RNA
ctgcagcccgtgtacatcctcaagtgcaactggtgt

SEQ ID NO: 29022 - RNA, 36 nt, synthetic construct
  misc_feature 1..36: note = derived and/or modified sequence opt3 from anti-HIV_CDR
  source 1..36: mol_type = other RNA
gagtacagattcgacgattggggccccctggaccac

SEQ ID NO: 29023 - RNA, 36 nt, synthetic construct
  misc_feature 1..36: note = derived and/or modified sequence opt3 from anti-HIV_CDR
  source 1..36: mol_type = other RNA
gccgcttgggacgatagcctgaacggccacggggtg

SEQ ID NO: 29024 - RNA, 36 nt, synthetic construct
  misc_feature 1..36: note = derived and/or modified sequence opt3 from anti-HIV_CDR
  source 1..36: mol_type = other RNA
ctgtacttcgactgggctccccacgcctttgatatc

SEQ ID NO: 29025 - RNA, 36 nt, synthetic construct
  misc_feature 1..36: note = derived and/or modified sequence opt3 from anti-HIV_CDR
  source 1..36: mol_type = other RNA
ggcctgtacgacagctccgggtattacttcggatat

SEQ ID NO: 29026 - RNA, 36 nt, synthetic construct
  misc_feature 1..36: note = derived and/or modified sequence opt3 from anti-HIV_CDR
  source 1..36: mol_type = other RNA
ctgggctgcagcgggggatcctgttacgaggactct

SEQ ID NO: 29027 - RNA, 36 nt, synthetic construct; identical to SEQ ID NO: 13743
  misc_feature 1..36: note = derived and/or modified sequence opt3 from anti-HIV_CDR
  source 1..36: mol_type = other RNA

SEQ ID NO: 29028 - RNA, 36 nt, synthetic construct; identical to SEQ ID NO: 13744
  misc_feature 1..36: note = derived and/or modified sequence opt3 from anti-HIV_CDR
  source 1..36: mol_type = other RNA

SEQ ID NO: 29029 - RNA, 36 nt, synthetic construct
  misc_feature 1..36: note = derived and/or modified sequence opt3 from anti-HIV_CDR
  source 1..36: mol_type = other RNA
gtgaagcagttcctggagtggctctaccttgactat

SEQ ID NO: 29030 - RNA, 36 nt, synthetic construct
  misc_feature 1..36: note = derived and/or modified sequence opt3 from anti-HIV_CDR
  source 1..36: mol_type = other RNA
ggcgtgagaagcatcgtcggggcccacttcgactac

SEQ ID NO: 29031 - RNA, 36 nt, synthetic construct
  misc_feature 1..36: note = derived and/or modified sequence opt3 from anti-HIV_CDR
  source 1..36: mol_type = other RNA
ggcgtggggaccagatactatgtctacttcgacagc

SEQ ID NO: 29032 - RNA, 36 nt, synthetic construct
  misc_feature 1..36: note = derived and/or modified sequence opt3 from anti-HIV_CDR
  source 1..36: mol_type = other RNA
gccccctacatcagctcctctcacctggactattgg

SEQ ID NO: 29033 - RNA, 36 nt, synthetic construct
  misc_feature 1..36: note = derived and/or modified sequence opt3 from anti-HIV_CDR
  source 1..36: mol_type = other RNA
agaggcatcgccgctgcagggttctactttcagcac

SEQ ID NO: 29034 - RNA, 36 nt, synthetic construct
  misc_feature 1..36: note = derived and/or modified sequence opt3 from anti-HIV_CDR
  source 1..36: mol_type = other RNA
agaggcatcgccgctgcagccttctactttcagacc

SEQ ID NO: 29035 - RNA, 36 nt, synthetic construct
  misc_feature 1..36: note = derived and/or modified sequence opt3 from anti-HIV_CDR
  source 1..36: mol_type = other RNA
agaggcatcgccgctgcagggttctactttcagaac

SEQ ID NO: 29036 - RNA, 36 nt, synthetic construct
  misc_feature 1..36: note = derived and/or modified sequence opt3 from anti-HIV_CDR
  source 1..36: mol_type = other RNA
cagagctacgacacctccctgacagatactggcgtg

SEQ ID NO: 29037 - RNA, 36 nt, synthetic construct
  misc_feature 1..36: note = derived and/or modified sequence opt3 from anti-HIV_CDR
  source 1..36: mol_type = other RNA
cagagctacgacacctccctgtctgatacaggcgtg

SEQ ID NO: 29038 - RNA, 36 nt, synthetic construct
  misc_feature 1..36: note = derived and/or modified sequence opt3 from anti-HIV_CDR
  source 1..36: mol_type = other RNA
agaaccacactggtgaacttcggcgtctttgacctc

SEQ ID NO: 29039 - RNA, 36 nt, synthetic construct
  misc_feature 1..36: note = derived and/or modified sequence opt3 from anti-HIV_CDR
  source 1..36: mol_type = other RNA
cccgtggtcaacaccatcctgccttactgcgacgtt

SEQ ID NO: 29040 - RNA, 36 nt, synthetic construct
  misc_feature 1..36: note = derived and/or modified sequence opt3 from anti-HIV_CDR
  source 1..36: mol_type = other RNA
tgctacagcggcagatccaggtatttctttgactct

SEQ ID NO: 29041 - RNA, 36 nt, synthetic construct
  misc_feature 1..36: note = derived and/or modified sequence opt3 from anti-HIV_CDR
  source 1..36: mol_type = other RNA
gccgcttgggacgatagcctggacggcttctgggtg

SEQ ID NO: 29042 - RNA, 36 nt, synthetic construct
  misc_feature 1..36: note = derived and/or modified sequence opt3 from anti-HIV_CDR
  source 1..36: mol_type = other RNA
ctgagaaggggctactatgacagcggggaggattac

SEQ ID NO: 29043 - RNA, 36 nt, synthetic construct
  misc_feature 1..36: note = derived and/or modified sequence opt3 from anti-HIV_CDR
  source 1..36: mol_type = other RNA
ctgagaaggggctacttcgacagcgggggagatcac

SEQ ID NO: 29044 - RNA, 36 nt, synthetic construct
  misc_feature 1..36: note = derived and/or modified sequence opt3 from anti-HIV_CDR
  source 1..36: mol_type = other RNA
agctcctacacctcttcaagtacactgggcgtggtc

SEQ ID NO: 29045 - RNA, 36 nt, synthetic construct
  misc_feature 1..36: note = derived and/or modified sequence opt3 from anti-HIV_CDR
  source 1..36: mol_type = other RNA
ctggacggcgaggccttcagatactattttgatagc

SEQ ID NO: 29046 - RNA, 36 nt, synthetic construct
  misc_feature 1..36: note = derived and/or modified sequence opt3 from anti-HIV_CDR
  source 1..36: mol_type = other RNA
agaaggggccagcggctgctcgcctacttcgactat

SEQ ID NO: 29047 - RNA, 36 nt, synthetic construct
  misc_feature 1..36: note = derived and/or modified sequence opt3 from anti-HIV_CDR
  source 1..36: mol_type = other RNA
ccccagtacaacctgggcagagagcctctcaatgtg

SEQ ID NO: 29048 - RNA, 36 nt, synthetic construct
  misc_feature 1..36: note = derived and/or modified sequence opt3 from anti-HIV_CDR
  source 1..36: mol_type = other RNA
gcccaccatgacttctggagagctcccgtggatgtc

SEQ ID NO: 29049 - RNA, 36 nt, synthetic construct
  misc_feature 1..36: note = derived and/or modified sequence opt3 from anti-HIV_CDR
  source 1..36: mol_type = other RNA
ggcagaagggaggggctgaacttcctccttgactac

SEQ ID NO: 29050 - RNA, 36 nt, synthetic construct
  misc_feature 1..36: note = derived and/or modified sequence opt3 from anti-HIV_CDR
  source 1..36: mol_type = other RNA
cccgagcctagctccatcgtgggcgccctgtactat

SEQ ID NO: 29051 - RNA, 36 nt, synthetic construct
  misc_feature 1..36: note = derived and/or modified sequence opt3 from anti-HIV_CDR
  source 1..36: mol_type = other RNA
ggccccgacgatttctggagcgggtaccctaagtat

SEQ ID NO: 29052 - RNA, 36 nt, synthetic construct
  misc_feature 1..36: note = derived and/or modified sequence opt3 from anti-HIV_CDR
  source 1..36: mol_type = other RNA
gactacagcgccgctggcagacacctgttcgattcc

SEQ ID NO: 29053 - RNA, 36 nt, synthetic construct
  misc_feature 1..36: note = derived and/or modified sequence opt3 from anti-HIV_CDR
  source 1..36: mol_type = other RNA
gactacaccgccagaggcaggcacttctttgattat

SEQ ID NO: 29054 - RNA, 36 nt, synthetic construct
  misc_feature 1..36: note = derived and/or modified sequence opt3 from anti-HIV_CDR
  source 1..36: mol_type = other RNA
gactacaccgccagcggcagacacttctttgattat

SEQ ID NO: 29055 - RNA, 36 nt, synthetic construct
  misc_feature 1..36: note = derived and/or modified sequence opt3 from anti-HIV_CDR
  source 1..36: mol_type = other RNA
cagagctacgactcctctctgtcaggcagttgggtg

SEQ ID NO: 29056 - RNA, 36 nt, synthetic construct
  misc_feature 1..36: note = derived and/or modified sequence opt3 from anti-HIV_CDR
  source 1..36: mol_type = other RNA
cccgcccaggctggcgtggggcctagattcgactac

SEQ ID NO: 29057 - RNA, 36 nt, synthetic construct
  misc_feature 1..36: note = derived and/or modified sequence opt3 from anti-HIV_CDR
  source 1..36: mol_type = other RNA
ggcgccatcaacagctctcccctgtacttcgactcc

SEQ ID NO: 29058 - RNA, 36 nt, synthetic construct
  misc_feature 1..36: note = derived and/or modified sequence opt3 from anti-HIV_CDR
  source 1..36: mol_type = other RNA
ggcgacatcacctccagccccctgtacttcgatttt

SEQ ID NO: 29059 - RNA, 36 nt, synthetic construct
  misc_feature 1..36: note = derived and/or modified sequence opt3 from anti-HIV_CDR
  source 1..36: mol_type = other RNA
ggcgccatcaacagctccccctcttacttcgactca

SEQ ID NO: 29060 - RNA, 36 nt, synthetic construct
  misc_feature 1..36: note = derived and/or modified sequence opt3 from anti-HIV_CDR
  source 1..36: mol_type = other RNA
tgggtggtcaccgccgctgaggaatacttcgactat

SEQ ID NO: 29061 - RNA, 39 nt, synthetic construct
  misc_feature 1..39: note = derived and/or modified sequence opt3 from anti-HIV_CDR
  source 1..39: mol_type = other RNA
gacccccaggtggaggtcagaggcaacgccttcgatatc

SEQ ID NO: 29062 - RNA, 39 nt, synthetic construct
  misc_feature 1..39: note = derived and/or modified sequence opt3 from anti-HIV_CDR
  source 1..39: mol_type = other RNA
gaccacggcgatcccagaaccgggtactatttcgactac

SEQ ID NO: 29063 - RNA, 39 nt, synthetic construct
  misc_feature 1..39: note = derived and/or modified sequence opt3 from anti-HIV_CDR
  source 1..39: mol_type = other RNA
gacgagagcggctacgatctgaactggcacctcgactcc

SEQ ID NO: 29064 - RNA, 39 nt, synthetic construct
  misc_feature 1..39: note = derived and/or modified sequence opt3 from anti-HIV_CDR
  source 1..39: mol_type = other RNA
gacggcagcggggatgacagaaactggcacctggatccc

SEQ ID NO: 29065 - RNA, 39 nt, synthetic construct
  misc_feature 1..39: note = derived and/or modified sequence opt3 from anti-HIV_CDR
  source 1..39: mol_type = other RNA
gacagaagggatgacggcctggattggctccttgacccc

SEQ ID NO: 29066 - RNA, 39 nt, synthetic construct
  misc_feature 1..39: note = derived and/or modified sequence opt3 from anti-HIV_CDR
  source 1..39: mol_type = other RNA
gacggcgggggagatgacagaacctggctgctcgatgcc

SEQ ID NO: 29067 - RNA, 39 nt, synthetic construct
  misc_feature 1..39: note = derived and/or modified sequence opt3 from anti-HIV_CDR
  source 1..39: mol_type = other RNA
gacggcagcggggatgccagagactggcatctgcacccc

SEQ ID NO: 29068 - RNA, 39 nt, synthetic construct
  misc_feature 1..39: note = derived and/or modified sequence opt3 from anti-HIV_CDR
  source 1..39: mol_type = other RNA
gacggcagcggggatgacacctcctggtacctggatccc

SEQ ID NO: 29069 - RNA, 39 nt, synthetic construct
  misc_feature 1..39: note = derived and/or modified sequence opt3 from anti-HIV_CDR
  source 1..39: mol_type = other RNA
gacggcagcggggatgacacctcctggcacctggatccc

SEQ ID NO: 29070 - RNA, 39 nt, synthetic construct
  misc_feature 1..39: note = derived and/or modified sequence opt3 from anti-HIV_CDR
  source 1..39: mol_type = other RNA
gacagaagggatgacgatcgggcctggctgctcgacccc

SEQ ID NO: 29071 - RNA, 39 nt, synthetic construct
  misc_feature 1..39: note = derived and/or modified sequence opt3 from anti-HIV_CDR
  source 1..39: mol_type = other RNA
gacggcagcggggatgccagagactggcacctggatccc

SEQ ID NO: 29072 - RNA, 39 nt, synthetic construct
  misc_feature 1..39: note = derived and/or modified sequence opt3 from anti-HIV_CDR
  source 1..39: mol_type = other RNA
gacggcagcggggatgccacctcctggcatctgcacccc

SEQ ID NO: 29073 - RNA, 39 nt, synthetic construct
  misc_feature 1..39: note = derived and/or modified sequence opt3 from anti-HIV_CDR
  source 1..39: mol_type = other RNA
gacgagagcggcgatgacctgaagtggcacctccatccc

SEQ ID NO: 29074 - RNA, 39 nt, synthetic construct
  misc_feature 1..39: note = derived and/or modified sequence opt3 from anti-HIV_CDR
  source 1..39: mol_type = other RNA
gacggcagcggggatgacacctcctggcatctgcacccc

SEQ ID NO: 29075 - RNA, 39 nt, synthetic construct
  misc_feature 1..39: note = derived and/or modified sequence opt3 from anti-HIV_CDR
  source 1..39: mol_type = other RNA
gcccagggcgacatcctgaccgaggggtacttcgattat

SEQ ID NO: 29076 - RNA, 39 nt, synthetic construct
  misc_feature 1..39: note = derived and/or modified sequence opt3 from anti-HIV_CDR
  source 1..39: mol_type = other RNA
gacagaatgttctggcagcaactggccaagtacgatagc

SEQ ID NO: 29077 - RNA, 39 nt, synthetic construct
  misc_feature 1..39: note = derived and/or modified sequence opt3 from anti-HIV_CDR
  source 1..39: mol_type = other RNA
agcacctgggactactccctgtctgcccacgaggatgtg

SEQ ID NO: 29078 - RNA, 39 nt, synthetic construct
  misc_feature 1..39: note = derived and/or modified sequence opt3 from anti-HIV_CDR
  source 1..39: mol_type = other RNA
gccgcttgggacgatagcctgtccggcctcaactgggtg

SEQ ID NO: 29079 - RNA, 39 nt, synthetic construct
  misc_feature 1..39: note = derived and/or modified sequence opt3 from anti-HIV_CDR
  source 1..39: mol_type = other RNA
ctgagctccgacagaatcgtggtcgttggccccgattac

SEQ ID NO: 29080 - RNA, 39 nt, synthetic construct
  misc_feature 1..39: note = derived and/or modified sequence opt3 from anti-HIV_CDR
  source 1..39: mol_type = other RNA
gaggccggcagcgtgaccgctacagggcccttcgactcc

SEQ ID NO: 29081 - RNA, 39 nt, synthetic construct
  misc_feature 1..39: note = derived and/or modified sequence opt3 from anti-HIV_CDR
  source 1..39: mol_type = other RNA
gacttcggcagagcctacgctatcgggtattttgagtac

SEQ ID NO: 29082 - RNA, 39 nt, synthetic construct
  misc_feature 1..39: note = derived and/or modified sequence opt3 from anti-HIV_CDR
  source 1..39: mol_type = other RNA
gacagagccccctacggcgctttcgagccttttgatttc

SEQ ID NO: 29083 - RNA, 39 nt, synthetic construct
  misc_feature 1..39: note = derived and/or modified sequence opt3 from anti-HIV_CDR
  source 1..39: mol_type = other RNA
aacggccacagctccctgggagggggttacttcccccat

SEQ ID NO: 29084 - RNA, 39 nt, synthetic construct
  misc_feature 1..39: note = derived and/or modified sequence opt3 from anti-HIV_CDR
  source 1..39: mol_type = other RNA
aacggccacagcgccctgggaggggagtacttccagcat

SEQ ID NO: 29085 - RNA, 39 nt, synthetic construct
  misc_feature 1..39: note = derived and/or modified sequence opt3 from anti-HIV_CDR
  source 1..39: mol_type = other RNA
gccgctagaagggcattctactattactatatggacgtg

SEQ ID NO: 29086 - RNA, 39 nt, synthetic construct
  misc_feature 1..39: note = derived and/or modified sequence opt3 from anti-HIV_CDR
  source 1..39: mol_type = other RNA
gccaactactatgacagctccggctacgggctggatatc

SEQ ID NO: 29087 - RNA, 39 nt, synthetic construct
  misc_feature 1..39: note = derived and/or modified sequence opt3 from anti-HIV_CDR
  source 1..39: mol_type = other RNA
cacagcagacccggcgcccctccacattacttcgactat

SEQ ID NO: 29088 - RNA, 39 nt, synthetic construct
  misc_feature 1..39: note = derived and/or modified sequence opt3 from anti-HIV_CDR
  source 1..39: mol_type = other RNA
ggcctgaccgtggccacactctacgacgctttcgatgtc

SEQ ID NO: 29089 - RNA, 39 nt, synthetic construct
  misc_feature 1..39: note = derived and/or modified sequence opt3 from anti-HIV_CDR
  source 1..39: mol_type = other RNA
agagacaggtacaactggaagtattactatctggatgtg

SEQ ID NO: 29090 - RNA, 39 nt, synthetic construct
  misc_feature 1..39: note = derived and/or modified sequence opt3 from anti-HIV_CDR
  source 1..39: mol_type = other RNA
gacagaggcagctccgggtggtacggatggctggatccc

SEQ ID NO: 29091 - RNA, 39 nt, synthetic construct
  misc_feature 1..39: note = derived and/or modified sequence opt3 from anti-HIV_CDR
  source 1..39: mol_type = other RNA
gacagactgagctccttctggtctggcgggatcgatcag

SEQ ID NO: 29092 - RNA, 39 nt, synthetic construct
  misc_feature 1..39: note = derived and/or modified sequence opt3 from anti-HIV_CDR
  source 1..39: mol_type = other RNA
gacgtgatcgtcggcgccctgctcggggctttcgatatt

SEQ ID NO: 29093 - RNA, 39 nt, synthetic construct
  misc_feature 1..39: note = derived and/or modified sequence opt3 from anti-HIV_CDR
  source 1..39: mol_type = other RNA
cacctgatcgcccccaccgctggcaactacttctatcct

SEQ ID NO: 29094 - RNA, 39 nt, synthetic construct
  misc_feature 1..39: note = derived and/or modified sequence opt3 from anti-HIV_CDR
  source 1..39: mol_type = other RNA
gacagcagaccccaggccctggtggctgcactcgatgtc

SEQ ID NO: 29095 - RNA, 39 nt, synthetic construct
  misc_feature 1..39: note = derived and/or modified sequence opt3 from anti-HIV_CDR
  source 1..39: mol_type = other RNA
gacgagatcgtgggcgccctgctcggggctttcgatatt

SEQ ID NO: 29096 - RNA, 39 nt, synthetic construct
  misc_feature 1..39: note = derived and/or modified sequence opt3 from anti-HIV_CDR
  source 1..39: mol_type = other RNA
agcgaccccgccatcgctgcagccggctccctggatctc

SEQ ID NO: 29097 - RNA, 39 nt, synthetic construct
  misc_feature 1..39: note = derived and/or modified sequence opt3 from anti-HIV_CDR
  source 1..39: mol_type = other RNA
ccctacgtgcagaccgtcgccacaactacgttcgacttt

SEQ ID NO: 29098 - RNA, 39 nt, synthetic construct
  misc_feature 1..39: note = derived and/or modified sequence opt3 from anti-HIV_CDR
  source 1..39: mol_type = other RNA
ggccccaagagcgtggcctccctgtcttacttcgacaaa

SEQ ID NO: 29099 - RNA, 39 nt, synthetic construct
  misc_feature 1..39: note = derived and/or modified sequence opt3 from anti-HIV_CDR
  source 1..39: mol_type = other RNA
ggcgccctgtggttcgggcagctcagaggacttgacccc

SEQ ID NO: 29100 - RNA, 39 nt, synthetic construct
  misc_feature 1..39: note = derived and/or modified sequence opt3 from anti-HIV_CDR
  source 1..39: mol_type = other RNA
gacctgagacccatgaggggcaactgggccatgcacgtg

SEQ ID NO: 29101 - RNA, 39 nt, synthetic construct
  misc_feature 1..39: note = derived and/or modified sequence opt3 from anti-HIV_CDR
  source 1..39: mol_type = other RNA
gacccccaggtgaacagaaggggcaattgcttcgatcac

SEQ ID NO: 29102 - RNA, 39 nt, synthetic construct
  misc_feature 1..39: note = derived and/or modified sequence opt3 from anti-HIV_CDR
  source 1..39: mol_type = other RNA
gacccccagatcgagattagaggcaacgccttcgatata

SEQ ID NO: 29103 - RNA, 39 nt, synthetic construct
  misc_feature 1..39: note = derived and/or modified sequence opt3 from anti-HIV_CDR
  source 1..39: mol_type = other RNA
gtgcccagaaccacagccactaggaacgctttcgacatc

SEQ ID NO: 29104 - RNA, 39 nt, synthetic construct
  misc_feature 1..39: note = derived and/or modified sequence opt3 from anti-HIV_CDR
  source 1..39: mol_type = other RNA
cacaagagcgtgctgctctggttcagagagcttgactac

SEQ ID NO: 29105 - RNA, 39 nt, synthetic construct
  misc_feature 1..39: note = derived and/or modified sequence opt3 from anti-HIV_CDR
  source 1..39: mol_type = other RNA
gacagcgaggattacgtggactattactatatggatgtc

SEQ ID NO: 29106 - RNA, 39 nt, synthetic construct
  misc_feature 1..39: note = derived and/or modified sequence opt3 from anti-HIV_CDR
  source 1..39: mol_type = other RNA
ctgcccagaaccacaggcatcaggaacgccttcgacatt

SEQ ID NO: 29107 - RNA, 39 nt, synthetic construct
  misc_feature 1..39: note = derived and/or modified sequence opt3 from anti-HIV_CDR
  source 1..39: mol_type = other RNA
ctgcccagaaccacaggcatcaggaacgccttcgacttt

SEQ ID NO: 29108 - RNA, 42 nt, synthetic construct
  misc_feature 1..42: note = derived and/or modified sequence opt3 from anti-HIV_CDR
  source 1..42: mol_type = other RNA
ggcaccctgtggttcggggagagcggactcagacttgaccac

SEQ ID NO: 29109 - RNA, 42 nt, synthetic construct
  misc_feature 1..42: note = derived and/or modified sequence opt3 from anti-HIV_CDR
  source 1..42: mol_type = other RNA
gtggcctacgtccacgttgtgaccacaagaagcctggacaac

SEQ ID NO: 29110 - RNA, 42 nt, synthetic construct
  misc_feature 1..42: note = derived and/or modified sequence opt3 from anti-HIV_CDR
  source 1..42: mol_type = other RNA
gccgactacgatctgctcaccagctcctatcacttcgactct

SEQ ID NO: 29111 - RNA, 42 nt, synthetic construct
  misc_feature 1..42: note = derived and/or modified sequence opt3 from anti-HIV_CDR
  source 1..42: mol_type = other RNA
accagatgcttcggcgccaactgttttaatttcatggacgtg

SEQ ID NO: 29112 - RNA, 42 nt, synthetic construct
  misc_feature 1..42: note = derived and/or modified sequence opt3 from anti-HIV_CDR
  source 1..42: mol_type = other RNA
ggcgggctgtactgcagctccatctcttgtattatggacgtg

SEQ ID NO: 29113 - RNA, 42 nt, synthetic construct
  misc_feature 1..42: note = derived and/or modified sequence opt3 from anti-HIV_CDR
  source 1..42: mol_type = other RNA
aacgagccccagtaccacagcctgcctggcatgttcgactat

SEQ ID NO: 29114 - RNA, 42 nt, synthetic construct
  misc_feature 1..42: note = derived and/or modified sequence opt3 from anti-HIV_CDR
  source 1..42: mol_type = other RNA
gagcccagagaaatgggcaccctgacagccgggttcgagtac

SEQ ID NO: 29115 - RNA, 42 nt, synthetic construct
  misc_feature 1..42: note = derived and/or modified sequence opt3 from anti-HIV_CDR
  source 1..42: mol_type = other RNA
gccaccggctacagctatgggtacctggacgctttcgatatc

SEQ ID NO: 29116 - RNA, 42 nt, synthetic construct
  misc_feature 1..42: note = derived and/or modified sequence opt3 from anti-HIV_CDR
  source 1..42: mol_type = other RNA
ggcagcctgtggttcggggagtccggactcagacttgaccac

SEQ ID NO: 29117 - RNA, 42 nt, synthetic construct
  misc_feature 1..42: note = derived and/or modified sequence opt3 from anti-HIV_CDR
  source 1..42: mol_type = other RNA
gacaacaccatcagcggcgtggtccccagatggttcgattac

SEQ ID NO: 29118 - RNA, 42 nt, synthetic construct
  misc_feature 1..42: note = derived and/or modified sequence opt3 from anti-HIV_CDR
  source 1..42: mol_type = other RNA
atctacgacggcagagggtattacagctatttctttgatctg

SEQ ID NO: 29119 - RNA, 42 nt, synthetic construct
  misc_feature 1..42: note = derived and/or modified sequence opt3 from anti-HIV_CDR
  source 1..42: mol_type = other RNA
gacagattcaactggaatgatggcgggtactttttcgacagc

SEQ ID NO: 29120 - RNA, 42 nt, synthetic construct
  misc_feature 1..42: note = derived and/or modified sequence opt3 from anti-HIV_CDR
  source 1..42: mol_type = other RNA
ggccacagctcctcttggaccaagttcaactggtttgggccc

SEQ ID NO: 29121 - RNA, 42 nt, synthetic construct
  misc_feature 1..42: note = derived and/or modified sequence opt3 from anti-HIV_CDR
  source 1..42: mol_type = other RNA
agcatcgccgctgacgattactattactattacatggacgtg

SEQ ID NO: 29122 - RNA, 42 nt, synthetic construct
  misc_feature 1..42: note = derived and/or modified sequence opt3 from anti-HIV_CDR
  source 1..42: mol_type = other RNA
agcttctacgacaacggcgggtattacctgggactcgattat

SEQ ID NO: 29123 - RNA, 42 nt, synthetic construct
  misc_feature 1..42: note = derived and/or modified sequence opt3 from anti-HIV_CDR
  source 1..42: mol_type = other RNA
gacaaggatgccagcatttacggctatagaatcctgaaccac

SEQ ID NO: 29124 - RNA, 42 nt, synthetic construct
  misc_feature 1..42: note = derived and/or modified sequence opt3 from anti-HIV_CDR
  source 1..42: mol_type = other RNA
gtgctgaccgacctcgatcagggcaaccccagaatggacgtc

SEQ ID NO: 29125 - RNA, 42 nt, synthetic construct
  misc_feature 1..42: note = derived and/or modified sequence opt3 from anti-HIV_CDR
  source 1..42: mol_type = other RNA
agagagatcaagttcggcgaactgagcttttacttcgactcc

SEQ ID NO: 29126 - RNA, 42 nt, synthetic construct
  misc_feature 1..42: note = derived and/or modified sequence opt3 from anti-HIV_CDR
  source 1..42: mol_type = other RNA
agagagatcaggttcggcgaactgagcttttacttcgactat

SEQ ID NO: 29127 - RNA, 42 nt, synthetic construct
  misc_feature 1..42: note = derived and/or modified sequence opt3 from anti-HIV_CDR
  source 1..42: mol_type = other RNA
ccccacagccctaccaacatcccatccagaccgctggactac

SEQ ID NO: 29128 - RNA, 42 nt, synthetic construct
  misc_feature 1..42: note = derived and/or modified sequence opt3 from anti-HIV_CDR
  source 1..42: mol_type = other RNA
ggcgactacgatatcctgaccagctcctatcagttcgactac

SEQ ID NO: 29129 - RNA, 42 nt, synthetic construct
  misc_feature 1..42: note = derived and/or modified sequence opt3 from anti-HIV_CDR
  source 1..42: mol_type = other RNA
agcacccctctggtgtggcccccagccaacggcctcgacgtc

SEQ ID NO: 29130 - RNA, 42 nt, synthetic construct
  misc_feature 1..42: note = derived and/or modified sequence opt3 from anti-HIV_CDR
  source 1..42: mol_type = other RNA
accagaaacacaggcaatagcctgccctactggttcgacctc

SEQ ID NO: 29131 - RNA, 45 nt, synthetic construct
  misc_feature 1..45: note = derived and/or modified sequence opt3 from anti-HIV_CDR
  source 1..45: mol_type = other RNA
gagaagggccagtggctgaccgtgcccccttactatttcgacagc

SEQ ID NO: 29132 - RNA, 45 nt, synthetic construct
  misc_feature 1..45: note = derived and/or modified sequence opt3 from anti-HIV_CDR
  source 1..45: mol_type = other RNA
ggcagcgggagatggaccatcggagccaggatttacttcgacaac

SEQ ID NO: 29133 - RNA, 45 nt, synthetic construct
  misc_feature 1..45: note = derived and/or modified sequence opt3 from anti-HIV_CDR
  source 1..45: mol_type = other RNA
ctggaggccgacggcgctgattacagccccaagatgttcgacttt

SEQ ID NO: 29134 - RNA, 45 nt, synthetic construct
  misc_feature 1..45: note = derived and/or modified sequence opt3 from anti-HIV_CDR
  source 1..45: mol_type = other RNA
ctggaggccgacggcggggattacagccccaagatgttcgactat

SEQ ID NO: 29135 - RNA, 45 nt, synthetic construct
  misc_feature 1..45: note = derived and/or modified sequence opt3 from anti-HIV_CDR
  source 1..45: mol_type = other RNA
ctggaggccgacggcgataactacagccccaagatggtggactat

SEQ ID NO: 29136 - RNA, 45 nt, synthetic construct
  misc_feature 1..45: note = derived and/or modified sequence opt3 from anti-HIV_CDR
  source 1..45: mol_type = other RNA
ctggaggccgacggcgatgactacagccccaagatgttcgattat

SEQ ID NO: 29137 - RNA, 45 nt, synthetic construct
  misc_feature 1..45: note = derived and/or modified sequence opt3 from anti-HIV_CDR
  source 1..45: mol_type = other RNA
ctggaggccgacggcagcgattactcccccaagatgttcgacttt

SEQ ID NO: 29138 - RNA, 45 nt, synthetic construct
  misc_feature 1..45: note = derived and/or modified sequence opt3 from anti-HIV_CDR
  source 1..45: mol_type = other RNA
ctggaggccgacggcgatgactacagccccaagatgttcgatcac

SEQ ID NO: 29139 - RNA, 45 nt, synthetic construct
  misc_feature 1..45: note = derived and/or modified sequence opt3 from anti-HIV_CDR
  source 1..45: mol_type = other RNA
ctggaggccgacggcgatgactacagccccaagatggtggattat

SEQ ID NO: 29140 - RNA, 45 nt, synthetic construct
  misc_feature 1..45: note = derived and/or modified sequence opt3 from anti-HIV_CDR
  source 1..45: mol_type = other RNA
gcccccagactggacctcggcgagcttagctccgggttccacttt

SEQ ID NO: 29141 - RNA, 45 nt, synthetic construct
  misc_feature 1..45: note = derived and/or modified sequence opt3 from anti-HIV_CDR
  source 1..45: mol_type = other RNA
gcccccagactggagctcggcgaacttagctccgggttccactac

SEQ ID NO: 29142 - RNA, 45 nt, synthetic construct
  misc_feature 1..45: note = derived and/or modified sequence opt3 from anti-HIV_CDR
  source 1..45: mol_type = other RNA
ggcaggctgctcatgcagtggccccctagagggggattcgaccca

SEQ ID NO: 29143 - RNA, 45 nt, synthetic construct
  misc_feature 1..45: note = derived and/or modified sequence opt3 from anti-HIV_CDR
  source 1..45: mol_type = other RNA
ggcaggctgttcatgcagtggccccctagagggggatttgaccca

SEQ ID NO: 29144 - RNA, 45 nt, synthetic construct
  misc_feature 1..45: note = derived and/or modified sequence opt3 from anti-HIV_CDR
  source 1..45: mol_type = other RNA
ggcagactgttcgtgcagtggccccctcaagggggatttgaccca

SEQ ID NO: 29145 - RNA, 45 nt, synthetic construct
  misc_feature 1..45: note = derived and/or modified sequence opt3 from anti-HIV_CDR
  source 1..45: mol_type = other RNA
ggcagactgttcatgcagtggccccctcaagggggatttgaccca

SEQ ID NO: 29146 - RNA, 45 nt, synthetic construct
  misc_feature 1..45: note = derived and/or modified sequence opt3 from anti-HIV_CDR
  source 1..45: mol_type = other RNA
ggcagactgttcgtgcagtggccccctcaagggggatttgacacc

SEQ ID NO: 29147 - RNA, 45 nt, synthetic construct
  misc_feature 1..45: note = derived and/or modified sequence opt3 from anti-HIV_CDR
  source 1..45: mol_type = other RNA
aacaataacaccagaaagagcatcaatattggccccgggagggcc

SEQ ID NO: 29148 - RNA, 45 nt, synthetic construct
  misc_feature 1..45: note = derived and/or modified sequence opt3 from anti-HIV_CDR
  source 1..45: mol_type = other RNA
cccggctactgcaacaataacatctgtacccactggttcgacaca

SEQ ID NO: 29149 - RNA, 45 nt, synthetic construct
  misc_feature 1..45: note = derived and/or modified sequence opt3 from anti-HIV_CDR
  source 1..45: mol_type = other RNA
gacctgctccccgattaccctgtgagctccgccccagaggacttc

SEQ ID NO: 29150 - RNA, 45 nt, synthetic construct
  misc_feature 1..45: note = derived and/or modified sequence opt3 from anti-HIV_CDR
  source 1..45: mol_type = other RNA
gagagctggctgtactccaacggcgactattactatatggatgtg

SEQ ID NO: 29151 - RNA, 45 nt, synthetic construct
  misc_feature 1..45: note = derived and/or modified sequence opt3 from anti-HIV_CDR
  source 1..45: mol_type = other RNA
agatactgcagctccaccacatgttataggggccacttcgactac

SEQ ID NO: 29152 - RNA, 45 nt, synthetic construct
  misc_feature 1..45: note = derived and/or modified sequence opt3 from anti-HIV_CDR
  source 1..45: mol_type = other RNA
cagaccacagacgagggcagacaatggctggtggggttccagcac

SEQ ID NO: 29153 - RNA, 45 nt, synthetic construct
  misc_feature 1..45: note = derived and/or modified sequence opt3 from anti-HIV_CDR
  source 1..45: mol_type = other RNA
cccagctacggcgggtatgacgatcagggatggtacttcgagtat

SEQ ID NO: 29154 - RNA, 45 nt, synthetic construct
  misc_feature 1..45: note = derived and/or modified sequence opt3 from anti-HIV_CDR
  source 1..45: mol_type = other RNA
gccgctatccccattggcgacagcaagtactcctatttcgattct

SEQ ID NO: 29155 - RNA, 45 nt, synthetic construct
  misc_feature 1..45: note = derived and/or modified sequence opt3 from anti-HIV_CDR
  source 1..45: mol_type = other RNA
gctccccctccaggcagcaccgagtgggcctactatttcgactac

SEQ ID NO: 29156 - RNA, 45 nt, synthetic construct
  misc_feature 1..45: note = derived and/or modified sequence opt3 from anti-HIV_CDR
  source 1..45: mol_type = other RNA
gcccagttccacaacagcggctactattactccgggctggactat

SEQ ID NO: 29157 - RNA, 45 nt, synthetic construct
  misc_feature 1..45: note = derived and/or modified sequence opt3 from anti-HIV_CDR
  source 1..45: mol_type = other RNA
ggcgggtacgactatggagatcactactattactatatggacgtg

SEQ ID NO: 29158 - RNA, 45 nt, synthetic construct
  misc_feature 1..45: note = derived and/or modified sequence opt3 from anti-HIV_CDR
  source 1..45: mol_type = other RNA
ggcacccagagctactccgccgtggctcccgggtggttcgaccct

SEQ ID NO: 29159 - RNA, 45 nt, synthetic construct
  misc_feature 1..45: note = derived and/or modified sequence opt3 from anti-HIV_CDR
  source 1..45: mol_type = other RNA
atcaaggggccccctagaggcaacttcggagtggccttttacttc

SEQ ID NO: 29160 - RNA, 45 nt, synthetic construct
  misc_feature 1..45: note = derived and/or modified sequence opt3 from anti-HIV_CDR
  source 1..45: mol_type = other RNA
aaggtgtacagcgacggctggtcccctcccaccgggttcgtctat

SEQ ID NO: 29161 - RNA, 45 nt, synthetic construct
  misc_feature 1..45: note = derived and/or modified sequence opt3 from anti-HIV_CDR
  source 1..45: mol_type = other RNA
agatacaagtatctgcccggcgaccagcacatgccttgggataac

SEQ ID NO: 29162 - RNA, 45 nt, synthetic construct
  misc_feature 1..45: note = derived and/or modified sequence opt3 from anti-HIV_CDR
  source 1..45: mol_type = other RNA
agatacaagtatctgcccggcgaccagcacatgccttgggattac

SEQ ID NO: 29163 - RNA, 45 nt, synthetic construct
  misc_feature 1..45: note = derived and/or modified sequence opt3 from anti-HIV_CDR
  source 1..45: mol_type = other RNA
ggcgggggatacgccgtggtcggtcccaagtatggcctggacgtt

SEQ ID NO: 29164 - RNA, 45 nt, synthetic construct
  misc_feature 1..45: note = derived and/or modified sequence opt3 from anti-HIV_CDR
  source 1..45: mol_type = other RNA
ctggacagctcctctggctgggaggaagtggggtacttcgataga

SEQ ID NO: 29165 - RNA, 45 nt, synthetic construct
  misc_feature 1..45: note = derived and/or modified sequence opt3 from anti-HIV_CDR
  source 1..45: mol_type = other RNA
gagaactacagcgacggctgggaagaggtggggcacttcgattat

SEQ ID NO: 29166 - RNA, 45 nt, synthetic construct
  misc_feature 1..45: note = derived and/or modified sequence opt3 from anti-HIV_CDR
  source 1..45: mol_type = other RNA
gagaactacagcgacggctgggaagaggtggggcacttcgattcc

SEQ ID NO: 29167 - RNA, 45 nt, synthetic construct
  misc_feature 1..45: note = derived and/or modified sequence opt3 from anti-HIV_CDR
  source 1..45: mol_type = other RNA
gagaactacagcgacggctggaatgaagtggggcacttcgatttt

SEQ ID NO: 29168 - RNA, 45 nt, synthetic construct
  misc_feature 1..45: note = derived and/or modified sequence opt3 from anti-HIV_CDR
  source 1..45: mol_type = other RNA
gagaactacagcgacggctggtatgaagtggggcacttcgatctg

SEQ ID NO: 29169 - RNA, 45 nt, synthetic construct
  misc_feature 1..45: note = derived and/or modified sequence opt3 from anti-HIV_CDR
  source 1..45: mol_type = other RNA
gacagaaggcggttcctggagtggagcctctacggcatggatgtg

SEQ ID NO: 29170 - RNA, 45 nt, synthetic construct
  misc_feature 1..45: note = derived and/or modified sequence opt3 from anti-HIV_CDR
  source 1..45: mol_type = other RNA
ggccccagagtgttctttgagagctccgggtactatttcagggac

SEQ ID NO: 29171 - RNA, 45 nt, synthetic construct
  misc_feature 1..45: note = derived and/or modified sequence opt3 from anti-HIV_CDR
  source 1..45: mol_type = other RNA
ggccccagagtgctgttcgagagctccgggcactacctcagggac

SEQ ID NO: 29172 - RNA, 45 nt, synthetic construct
  misc_feature 1..45: note = derived and/or modified sequence opt3 from anti-HIV_CDR
  source 1..45: mol_type = other RNA
ggccccagagtgttctttgagagctccgggtactatttcaggaac

SEQ ID NO: 29173 - RNA, 45 nt, synthetic construct
  misc_feature 1..45: note = derived and/or modified sequence opt3 from anti-HIV_CDR
  source 1..45: mol_type = other RNA
gagggcgggagcctgtggttcggaggtgccaactggctcgacccc

SEQ ID NO: 29174 - RNA, 45 nt, synthetic construct
  misc_feature 1..45: note = derived and/or modified sequence opt3 from anti-HIV_CDR
  source 1..45: mol_type = other RNA
gccgactacgataacatctgggacagcagaggcgggttcgatctg

SEQ ID NO: 29175 - RNA, 45 nt, synthetic construct
  misc_feature 1..45: note = derived and/or modified sequence opt3 from anti-HIV_CDR
  source 1..45: mol_type = other RNA
gtgggcgggaccgtctggagcggatactccaactatctggactac

SEQ ID NO: 29176 - RNA, 45 nt, synthetic construct
  misc_feature 1..45: note = derived and/or modified sequence opt3 from anti-HIV_CDR
  source 1..45: mol_type = other RNA
gacaacagagatcagtggctggtgctcaggagctggttcgacccc

SEQ ID NO: 29177 - RNA, 45 nt, synthetic construct
  misc_feature 1..45: note = derived and/or modified sequence opt3 from anti-HIV_CDR
  source 1..45: mol_type = other RNA
gagaagggccagtgggtgaccctgcccccttactatttcgacagc

SEQ ID NO: 29178 - RNA, 48 nt, synthetic construct
  misc_feature 1..48: note = derived and/or modified sequence opt3 from anti-HIV_CDR
  source 1..48: mol_type = other RNA
tacttcagcgacaccgatagatccgagtattctccctcactgaggagt

SEQ ID NO: 29179 - RNA, 48 nt, synthetic construct
  misc_feature 1..48: note = derived and/or modified sequence opt3 from anti-HIV_CDR
  source 1..48: mol_type = other RNA
tacatcagcgacagagagtccgccacctataatccctctctgaactca

SEQ ID NO: 29180 - RNA, 48 nt, synthetic construct
  misc_feature 1..48: note = derived and/or modified sequence opt3 from anti-HIV_CDR
  source 1..48: mol_type = other RNA
tacttcagcgacaccgagaagtccaactataatccctctctgagatca

SEQ ID NO: 29181 - RNA, 48 nt, synthetic construct
  misc_feature 1..48: note = derived and/or modified sequence opt3 from anti-HIV_CDR
  source 1..48: mol_type = other RNA
tacatcagcgacagagcctccgctacctataatccctctctgaactca

SEQ ID NO: 29182 - RNA, 48 nt, synthetic construct
  misc_feature 1..48: note = derived and/or modified sequence opt3 from anti-HIV_CDR
  source 1..48: mol_type = other RNA
tacgtgcaccatagcggcgacaccaactataatccctccctgaagaga

SEQ ID NO: 29183 - RNA, 48 nt, synthetic construct
  misc_feature 1..48: note = derived and/or modified sequence opt3 from anti-HIV_CDR
  source 1..48: mol_type = other RNA
tacgtgcacaagagcggcgacaccaactattccccctctctgaaatca

SEQ ID NO: 29184 - RNA, 48 nt, synthetic construct
  misc_feature 1..48: note = derived and/or modified sequence opt3 from anti-HIV_CDR
  source 1..48: mol_type = other RNA
tacgtgcacgacagcggcgataccaactataatccctccctgaagtct

SEQ ID NO: 29185 - RNA, 48 nt, synthetic construct
  misc_feature 1..48: note = derived and/or modified sequence opt3 from anti-HIV_CDR
  source 1..48: mol_type = other RNA
tacatcagcaagtccgagtctgccaactataatccctcactgaacagt

SEQ ID NO: 29186 - RNA, 48 nt, synthetic construct
  misc_feature 1..48: note = derived and/or modified sequence opt3 from anti-HIV_CDR
  source 1..48: mol_type = other RNA
tacatctattacagcggctccaccaactataatccctctctgaagtca

SEQ ID NO: 29187 - RNA, 48 nt, synthetic construct
  misc_feature 1..48: note = derived and/or modified sequence opt3 from anti-HIV_CDR
  source 1..48: mol_type = other RNA
tacgtgcacgacagcggcgatatcaactataatccctccctgaagaac

SEQ ID NO: 29188 - RNA, 48 nt, synthetic construct
  misc_feature 1..48: note = derived and/or modified sequence opt3 from anti-HIV_CDR
  source 1..48: mol_type = other RNA
agctactatgacttctccatcggcgatgggaacgacgcctttgatgtg

SEQ ID NO: 29189 - RNA, 48 nt, synthetic construct
  misc_feature 1..48: note = derived and/or modified sequence opt3 from anti-HIV_CDR
  source 1..48: mol_type = other RNA
ggcttcagagggagccccttttcctctggatcactgtacttcgacagt

SEQ ID NO: 29190 - RNA, 48 nt, synthetic construct
  misc_feature 1..48: note = derived and/or modified sequence opt3 from anti-HIV_CDR
  source 1..48: mol_type = other RNA
gtgatcagcggcagaattaccatattctactataactacatcgacgtc

SEQ ID NO: 29191 - RNA, 48 nt, synthetic construct
  misc_feature 1..48: note = derived and/or modified sequence opt3 from anti-HIV_CDR
  source 1..48: mol_type = other RNA
gacggcctgggggaggtggcccccgattacagatatggaatcgacgtc

SEQ ID NO: 29192 - RNA, 48 nt, synthetic construct
  misc_feature 1..48: note = derived and/or modified sequence opt3 from anti-HIV_CDR
  source 1..48: mol_type = other RNA
gacggcctgggggagctcgcccccgcttaccagtatggaatcgatgtg

SEQ ID NO: 29193 - RNA, 48 nt, synthetic construct
  misc_feature 1..48: note = derived and/or modified sequence opt3 from anti-HIV_CDR
  source 1..48: mol_type = other RNA
gacggcctgggggagctcgcccccgcttaccactatggaatcgatgtg

SEQ ID NO: 29194 - RNA, 48 nt, synthetic construct
  misc_feature 1..48: note = derived and/or modified sequence opt3 from anti-HIV_CDR
  source 1..48: mol_type = other RNA
gacggcctgggggaggtggcccccgcttacctctatggaatcgatgca

SEQ ID NO: 29195 - RNA, 48 nt, synthetic construct
  misc_feature 1..48: note = derived and/or modified sequence opt3 from anti-HIV_CDR
  source 1..48: mol_type = other RNA
gccgtgaagggcttctggtttgacgaggtctacaactggttcgggccc

SEQ ID NO: 29196 - RNA, 48 nt, synthetic construct
  misc_feature 1..48: note = derived and/or modified sequence opt3 from anti-HIV_CDR
  source 1..48: mol_type = other RNA
gccgtgaagggcttctggtttgacgatccctacacctggttcgggcct

SEQ ID NO: 29197 - RNA, 48 nt, synthetic construct
  misc_feature 1..48: note = derived and/or modified sequence opt3 from anti-HIV_CDR
  source 1..48: mol_type = other RNA
gccgtgaagggcttctggtttgacgagcccagcacctggttcgggcct

SEQ ID NO: 29198 - RNA, 48 nt, synthetic construct
  misc_feature 1..48: note = derived and/or modified sequence opt3 from anti-HIV_CDR
  source 1..48: mol_type = other RNA
gccgtgaagggcctgtggttcgacgagacctacacatggtttgggccc

SEQ ID NO: 29199 - RNA, 48 nt, synthetic construct
  misc_feature 1..48: note = derived and/or modified sequence opt3 from anti-HIV_CDR
  source 1..48: mol_type = other RNA
gccgtggctggcctgtggttcgaggacgcatacaactggtttgggccc

SEQ ID NO: 29200 - RNA, 48 nt, synthetic construct
  misc_feature 1..48: note = derived and/or modified sequence opt3 from anti-HIV_CDR
  source 1..48: mol_type = other RNA
gccgaggctgaaagccagtcccactctagacccatcatgttcgactac

SEQ ID NO: 29201 - RNA, 48 nt, synthetic construct
  misc_feature 1..48: note = derived and/or modified sequence opt3 from anti-HIV_CDR
  source 1..48: mol_type = other RNA
gccgaggctgcaagcgactcccactctagacccatcatgttcgatcat

SEQ ID NO: 29202 - RNA, 48 nt, synthetic construct
  misc_feature 1..48: note = derived and/or modified sequence opt3 from anti-HIV_CDR
  source 1..48: mol_type = other RNA
ctggaggccgaaagcgactcccactctagacccatcatgttcgatcat

SEQ ID NO: 29203 - RNA, 48 nt, synthetic construct
  misc_feature 1..48: note = derived and/or modified sequence opt3 from anti-HIV_CDR
  source 1..48: mol_type = other RNA
gccgaggctgaaagccagtcccactctagacccatcatgttcgactca

SEQ ID NO: 29204 - RNA, 48 nt, synthetic construct
  misc_feature 1..48: note = derived and/or modified sequence opt3 from anti-HIV_CDR
  source 1..48: mol_type = other RNA
gccgaggctgaaagccagtcccactctagacccatcatgttcgacttt

SEQ ID NO: 29205 - RNA, 48 nt, synthetic construct
  misc_feature 1..48: note = derived and/or modified sequence opt3 from anti-HIV_CDR
  source 1..48: mol_type = other RNA
gacaaccccctgctccagagcggcgagttctcctcttcacttgaaaat

SEQ ID NO: 29206 - RNA, 48 nt, synthetic construct
  misc_feature 1..48: note = derived and/or modified sequence opt3 from anti-HIV_CDR
  source 1..48: mol_type = other RNA
gacaaccccctgctccagagcggcgagttctcctcttcacttgataat

SEQ ID NO: 29207 - RNA, 48 nt, synthetic construct
  misc_feature 1..48: note = derived and/or modified sequence opt3 from anti-HIV_CDR
  source 1..48: mol_type = other RNA
ggcagagactacaacttctggggagggggtggcaagatcaattttccc

SEQ ID NO: 29208 - RNA, 48 nt, synthetic construct
  misc_feature 1..48: note = derived and/or modified sequence opt3 from anti-HIV_CDR
  source 1..48: mol_type = other RNA
accaactgggccaatgacttcgtgacaggctactatagatttgatttc

SEQ ID NO: 29209 - RNA, 48 nt, synthetic construct
  misc_feature 1..48: note = derived and/or modified sequence opt3 from anti-HIV_CDR
  source 1..48: mol_type = other RNA
gccggccactgcagctccacctcttcagtgtactgtcccttcgacatg

SEQ ID NO: 29210 - RNA, 48 nt, synthetic construct
  misc_feature 1..48: note = derived and/or modified sequence opt3 from anti-HIV_CDR
  source 1..48: mol_type = other RNA
caggtgagctcctactcttcaagtggctatagaagggagttcgactac

SEQ ID NO: 29211 - RNA, 48 nt, synthetic construct
  misc_feature 1..48: note = derived and/or modified sequence opt3 from anti-HIV_CDR
  source 1..48: mol_type = other RNA
agaatggccaccctgacaggcgggtactattactattacatggacgtg

SEQ ID NO: 29212 - RNA, 48 nt, synthetic construct
  misc_feature 1..48: note = derived and/or modified sequence opt3 from anti-HIV_CDR
  source 1..48: mol_type = other RNA
gagggcgggtacagcgacttctggtccggatattctggttttgattac

SEQ ID NO: 29213 - RNA, 48 nt, synthetic construct
  misc_feature 1..48: note = derived and/or modified sequence opt3 from anti-HIV_CDR
  source 1..48: mol_type = other RNA
ctgtactataacttcggcagcgggtacgacaccggaatcggtgatcac

SEQ ID NO: 29214 - RNA, 48 nt, synthetic construct
  misc_feature 1..48: note = derived and/or modified sequence opt3 from anti-HIV_CDR
  source 1..48: mol_type = other RNA
gccagggagggcagatggttcagcgacaactactatgctatggatgtg

SEQ ID NO: 29215 - RNA, 48 nt, synthetic construct
  misc_feature 1..48: note = derived and/or modified sequence opt3 from anti-HIV_CDR
  source 1..48: mol_type = other RNA
gacagagtgggcaggcggctgggggagctcagcgccggattcgattac

SEQ ID NO: 29216 - RNA, 48 nt, synthetic construct
  misc_feature 1..48: note = derived and/or modified sequence opt3 from anti-HIV_CDR
  source 1..48: mol_type = other RNA
gccagacccaggagcccttgggactccaccggctggtctgtggggtac

SEQ ID NO: 29217 - RNA, 48 nt, synthetic construct
  misc_feature 1..48: note = derived and/or modified sequence opt3 from anti-HIV_CDR
  source 1..48: mol_type = other RNA
agctactatgacttcagatccgattctggcaacgacgcctttgatatc

SEQ ID NO: 29218 - RNA, 48 nt, synthetic construct
  misc_feature 1..48: note = derived and/or modified sequence opt3 from anti-HIV_CDR
  source 1..48: mol_type = other RNA
agctactatgacttccagaccgattccggcaacgacgcctttgatgtg

SEQ ID NO: 29219 - RNA, 48 nt, synthetic construct
  misc_feature 1..48: note = derived and/or modified sequence opt3 from anti-HIV_CDR
  source 1..48: mol_type = other RNA
gacaaccccgtgctgcagctcggcgagcttagctcctctctggattac

SEQ ID NO: 29220 - RNA, 48 nt, synthetic construct
  misc_feature 1..48: note = derived and/or modified sequence opt3 from anti-HIV_CDR
  source 1..48: mol_type = other RNA
ggcttcagagggagccccttttcctctggatcaatgtacttcgacagt

SEQ ID NO: 29221 - RNA, 48 nt, synthetic construct
  misc_feature 1..48: note = derived and/or modified sequence opt3 from anti-HIV_CDR
  source 1..48: mol_type = other RNA
ggcttcagagggagccccctgtcctctggatcactctactttgacagt

SEQ ID NO: 29222 - RNA, 48 nt, synthetic construct
  misc_feature 1..48: note = derived and/or modified sequence opt3 from anti-HIV_CDR
  source 1..48: mol_type = other RNA
ggcttcagagggaacgtgtttagcaccggatggttctacctggacttt

SEQ ID NO: 29223 - RNA, 48 nt, synthetic construct
  misc_feature 1..48: note = derived and/or modified sequence opt3 from anti-HIV_CDR
  source 1..48: mol_type = other RNA
gacagactgagcttctccgtgcaggtcgagcaaggcgttctcgattac

SEQ ID NO: 29224 - RNA, 48 nt, synthetic construct
  misc_feature 1..48: note = derived and/or modified sequence opt3 from anti-HIV_CDR
  source 1..48: mol_type = other RNA
gacagactgagcttctccgtgcaggtcgagcaaggcgttctccagttt

SEQ ID NO: 29225 - RNA, 48 nt, synthetic construct
  misc_feature 1..48: note = derived and/or modified sequence opt3 from anti-HIV_CDR
  source 1..48: mol_type = other RNA
gtgctgagcggcagaatcaccattttctactattactatatggacgtc

SEQ ID NO: 29226 - RNA, 51 nt, synthetic construct
  misc_feature 1..51: note = derived and/or modified sequence opt3 from anti-HIV_CDR
  source 1..51: mol_type = other RNA
tacatcagctccgggtcttcaaccctgcactatgccgacacagtgaagggc

SEQ ID NO: 29227 - RNA, 51 nt, synthetic construct
  misc_feature 1..51: note = derived and/or modified sequence opt3 from anti-HIV_CDR
  source 1..51: mol_type = other RNA
agatacctggactggagccccatcggcagggatacctatgggacagacgtg

SEQ ID NO: 29228 - RNA, 51 nt, synthetic construct
  misc_feature 1..51: note = derived and/or modified sequence opt3 from anti-HIV_CDR
  source 1..51: mol_type = other RNA
agatacttcgactggagcccctttaggcgggatacctatggcacagacgtg

SEQ ID NO: 29229 - RNA, 51 nt, synthetic construct
  misc_feature 1..51: note = derived and/or modified sequence opt3 from anti-HIV_CDR
  source 1..51: mol_type = other RNA
ggcagagactacaacttctggagcgggggaggtaggtattactttgatttc

SEQ ID NO: 29230 - RNA, 51 nt, synthetic construct
  misc_feature 1..51: note = derived and/or modified sequence opt3 from anti-HIV_CDR
  source 1..51: mol_type = other RNA
ggcatccaggaggactacgatttctggagagaatatagggagctggactac

SEQ ID NO: 29231 - RNA, 51 nt, synthetic construct
  misc_feature 1..51: note = derived and/or modified sequence opt3 from anti-HIV_CDR
  source 1..51: mol_type = other RNA
gtgctgaacaataacaccagaaagagcatcaatattggccccgggagggcc

SEQ ID NO: 29232 - RNA, 51 nt, synthetic construct
  misc_feature 1..51: note = derived and/or modified sequence opt3 from anti-HIV_CDR
  source 1..51: mol_type = other RNA
gacctgaacttcggcgtggtcaccccctactattactattacctcgatgtt

SEQ ID NO: 29233 - RNA, 51 nt, synthetic construct
  misc_feature 1..51: note = derived and/or modified sequence opt3 from anti-HIV_CDR
  source 1..51: mol_type = other RNA
cacggcagaaccgtgttcggggtcgttaggaactactattacatggacgtg

SEQ ID NO: 29234 - RNA, 51 nt, synthetic construct
  misc_feature 1..51: note = derived and/or modified sequence opt3 from anti-HIV_CDR
  source 1..51: mol_type = other RNA
cactactatggcagcgggctgaccaaggactactatgagtacatcgatgtg

SEQ ID NO: 29235 - RNA, 51 nt, synthetic construct
  misc_feature 1..51: note = derived and/or modified sequence opt3 from anti-HIV_CDR
  source 1..51: mol_type = other RNA
acctactataacttctggagcgaccagtcccaaggcctggattttgactac

SEQ ID NO: 29236 - RNA, 51 nt, synthetic construct
  misc_feature 1..51: note = derived and/or modified sequence opt3 from anti-HIV_CDR
  source 1..51: mol_type = other RNA
ggcgtgtgggaggcccccgacgggagctcctactattactatatggctgat

SEQ ID NO: 29237 - RNA, 51 nt, synthetic construct
  misc_feature 1..51: note = derived and/or modified sequence opt3 from anti-HIV_CDR
  source 1..51: mol_type = other RNA
gaccagggcgggtaccccgtgagccctgtcggaccaaagtggttcgatccg

SEQ ID NO: 29238 - RNA, 51 nt, synthetic construct
  misc_feature 1..51: note = derived and/or modified sequence opt3 from anti-HIV_CDR
  source 1..51: mol_type = other RNA
agagacaagtaccagtatatcgatagctccggcgactaccccttcgatagg

SEQ ID NO: 29239 - RNA, 51 nt, synthetic construct
  misc_feature 1..51: note = derived and/or modified sequence opt3 from anti-HIV_CDR
  source 1..51: mol_type = other RNA
cagctgagagcccccaccacaaggttccggcacggcgggtactttgagaac

SEQ ID NO: 29240 - RNA, 51 nt, synthetic construct
  misc_feature 1..51: note = derived and/or modified sequence opt3 from anti-HIV_CDR
  source 1..51: mol_type = other RNA
caggtgagagcccccaccctgaggttccggcacggcgggtactttgagaca

SEQ ID NO: 29241 - RNA, 51 nt, synthetic construct
  misc_feature 1..51: note = derived and/or modified sequence opt3 from anti-HIV_CDR
  source 1..51: mol_type = other RNA
gtgagcatcacctacgccggcctgattgtcgttcccggggctttcgacgtg

SEQ ID NO: 29242 - RNA, 51 nt, synthetic construct
  misc_feature 1..51: note = derived and/or modified sequence opt3 from anti-HIV_CDR
  source 1..51: mol_type = other RNA
gtggccatcagctacgctggcctgattgtcgttcccgggcctttcgacgtg

SEQ ID NO: 29243 - RNA, 51 nt, synthetic construct
  misc_feature 1..51: note = derived and/or modified sequence opt3 from anti-HIV_CDR
  source 1..51: mol_type = other RNA
agcctgaccggcagactccaccttggggagctgtcctctggaatcggtccc

SEQ ID NO: 29244 - RNA, 51 nt, synthetic construct
  misc_feature 1..51: note = derived and/or modified sequence opt3 from anti-HIV_CDR
  source 1..51: mol_type = other RNA
ggcgggagcgccctgatcaccattttcggagtggaccccaagtttgatcct

SEQ ID NO: 29245 - RNA, 51 nt, synthetic construct
  misc_feature 1..51: note = derived and/or modified sequence opt3 from anti-HIV_CDR
  source 1..51: mol_type = other RNA
atggccctgaccagcggcccctacgacgtgtccgggtattacttcgattat

SEQ ID NO: 29246 - RNA, 51 nt, synthetic construct
  misc_feature 1..51: note = derived and/or modified sequence opt3 from anti-HIV_CDR
  source 1..51: mol_type = other RNA
atggccctggctagcggcccctacgacgtgtccgggtattacttcgattat

SEQ ID NO: 29247 - RNA, 51 nt, synthetic construct
  misc_feature 1..51: note = derived and/or modified sequence opt3 from anti-HIV_CDR
  source 1..51: mol_type = other RNA
atggccctgcccagcggccctctcgacagatccgggtactatttcgatgac

SEQ ID NO: 29248 - RNA, 54 nt, synthetic construct
  misc_feature 1..54: note = derived and/or modified sequence opt3 from anti-HIV_CDR
  source 1..54: mol_type = other RNA
gtggtccccatgttcagcatctttggcgttgtgaaggccaactacttcgactat

SEQ ID NO: 29249 - RNA, 54 nt, synthetic construct
  misc_feature 1..54: note = derived and/or modified sequence opt3 from anti-HIV_CDR
  source 1..54: mol_type = other RNA
aacagaagggtggccatgcccgaggctatgatcctgagcttctacatggacgtc

SEQ ID NO: 29250 - RNA, 54 nt, synthetic construct
  misc_feature 1..54: note = derived and/or modified sequence opt3 from anti-HIV_CDR
  source 1..54: mol_type = other RNA
ggcctgtgcagagggggaaactgtaggctcggtcccagcggctggcttgaccct

SEQ ID NO: 29251 - RNA, 54 nt, synthetic construct
  misc_feature 1..54: note = derived and/or modified sequence opt3 from anti-HIV_CDR
  source 1..54: mol_type = other RNA
acaccccctcactacgacgtgctgaccggctatccaagctccgtcctcgagttc

SEQ ID NO: 29252 - RNA, 54 nt, synthetic construct
  misc_feature 1..54: note = derived and/or modified sequence opt3 from anti-HIV_CDR
  source 1..54: mol_type = other RNA
atcccctaccacagcgagtcctattacaaggtggtcattggcgggttcgacgtt

SEQ ID NO: 29253 - RNA, 54 nt, synthetic construct
  misc_feature 1..54: note = derived and/or modified sequence opt3 from anti-HIV_CDR
  source 1..54: mol_type = other RNA
gccgaccccttcaaggtggctcaggatgagggcctgtttgtcatcttcgactac

SEQ ID NO: 29254 - RNA, 54 nt, synthetic construct
  misc_feature 1..54: note = derived and/or modified sequence opt3 from anti-HIV_CDR
  source 1..54: mol_type = other RNA
gccgaccccttcaaggtggctcaggatgagggcctgtacgtcatctttgactat

SEQ ID NO: 29255 - RNA, 54 nt, synthetic construct
  misc_feature 1..54: note = derived and/or modified sequence opt3 from anti-HIV_CDR
  source 1..54: mol_type = other RNA
gccgacagattcaaggtggctcaggatgagggcctgtttgtcatcttcgactac

SEQ ID NO: 29256 - RNA, 54 nt, synthetic construct
  misc_feature 1..54: note = derived and/or modified sequence opt3 from anti-HIV_CDR
  source 1..54: mol_type = other RNA
ggcagacagaccttcagggccatctggagcgggccccctgctgtgtttgacatt

SEQ ID NO: 29257 - RNA, 54 nt, synthetic construct
  misc_feature 1..54: note = derived and/or modified sequence opt3 from anti-HIV_CDR
  source 1..54: mol_type = other RNA
ggcagacagaccttcagggccatctggagcgggccccctgtggtctttgacatt

SEQ ID NO: 29258 - RNA, 54 nt, synthetic construct
  misc_feature 1..54: note = derived and/or modified sequence opt3 from anti-HIV_CDR
  source 1..54: mol_type = other RNA
agcagaggcgactacaacttctggtccgggtatcccgagtaccactttgatagg

SEQ ID NO: 29259 - RNA, 54 nt, synthetic construct
  misc_feature 1..54: note = derived and/or modified sequence opt3 from anti-HIV_CDR
  source 1..54: mol_type = other RNA
ctgcccaagagcagaatggtgggcggggaccacctccctttctacccagatttt

SEQ ID NO: 29260 - RNA, 54 nt, synthetic construct
  misc_feature 1..54: note = derived and/or modified sequence opt3 from anti-HIV_CDR
  source 1..54: mol_type = other RNA
ctgaccggccccagcgggtactgcgactcctctggatgttattggttcgatcct

SEQ ID NO: 29261 - RNA, 54 nt, synthetic construct
  misc_feature 1..54: note = derived and/or modified sequence opt3 from anti-HIV_CDR
  source 1..54: mol_type = other RNA
ggcgggagcatgatcagaggagtgccctcccctttctactatggtatggacgtc

SEQ ID NO: 29262 - RNA, 54 nt, synthetic construct
  misc_feature 1..54: note = derived and/or modified sequence opt3 from anti-HIV_CDR
  source 1..54: mol_type = other RNA
ctgttcggcgccaagagactcggggtggctcccagcggatactatatggacgtc

SEQ ID NO: 29263 - RNA, 54 nt, synthetic construct
  misc_feature 1..54: note = derived and/or modified sequence opt3 from anti-HIV_CDR
  source 1..54: mol_type = other RNA
gacagatacgaggccgcttggttcggcgcagataaggtgtatgggatggacgtc

SEQ ID NO: 29264 - RNA, 54 nt, synthetic construct
  misc_feature 1..54: note = derived and/or modified sequence opt3 from anti-HIV_CDR
  source 1..54: mol_type = other RNA
gagcacagactgccccctccaaccggcaggcggacacgcaactggttcgacccg

SEQ ID NO: 29265 - RNA, 54 nt, synthetic construct
  misc_feature 1..54: note = derived and/or modified sequence opt3 from anti-HIV_CDR
  source 1..54: mol_type = other RNA
ggcagagggagcttccagggatttcaacagtacgagtattacggtatggacgtg

SEQ ID NO: 29266 - RNA, 54 nt, synthetic construct
  misc_feature 1..54: note = derived and/or modified sequence opt3 from anti-HIV_CDR
  source 1..54: mol_type = other RNA
ggcagagggtacagccacggattccagcaatataactactatggtatggacgtg

SEQ ID NO: 29267 - RNA, 54 nt, synthetic construct
  misc_feature 1..54: note = derived and/or modified sequence opt3 from anti-HIV_CDR
  source 1..54: mol_type = other RNA
ggcagagggagcttcaccggatttgaccagtaccactattacggtatggatgtg

SEQ ID NO: 29268 - RNA, 54 nt, synthetic construct
  misc_feature 1..54: note = derived and/or modified sequence opt3 from anti-HIV_CDR
  source 1..54: mol_type = other RNA
ggcagagggagcaccttcccctccgcccagttttcttacttcggactggacgtg

SEQ ID NO: 29269 - RNA, 54 nt, synthetic construct
  misc_feature 1..54: note = derived and/or modified sequence opt3 from anti-HIV_CDR
  source 1..54: mol_type = other RNA
gacctggccagatacggcgtgaccagcatcgtccccgagttcgggtttgatttc

SEQ ID NO: 29270 - RNA, 54 nt, synthetic construct
  misc_feature 1..54: note = derived and/or modified sequence opt3 from anti-HIV_CDR
  source 1..54: mol_type = other RNA
agaggcaggctgaacatccccagcccttccgccattctcaccgctttcgacgtg

SEQ ID NO: 29271 - RNA, 54 nt, synthetic construct
  misc_feature 1..54: note = derived and/or modified sequence opt3 from anti-HIV_CDR
  source 1..54: mol_type = other RNA
ggccccgggagcatggtgagaggactgatcgtcacctcctacggtatggacgtt

SEQ ID NO: 29272 - RNA, 54 nt, synthetic construct
  misc_feature 1..54: note = derived and/or modified sequence opt3 from anti-HIV_CDR
  source 1..54: mol_type = other RNA
aagagagtgaccatcttcggcgtcgttgacacacccagggggtactttgattat

SEQ ID NO: 29273 - RNA, 54 nt, synthetic construct
  misc_feature 1..54: note = derived and/or modified sequence opt3 from anti-HIV_CDR
  source 1..54: mol_type = other RNA
ggccagagaaacgtgctgcacttcctcgagaggaagaatgacgcctttgatatc

SEQ ID NO: 29274 - RNA, 54 nt, synthetic construct
  misc_feature 1..54: note = derived and/or modified sequence opt3 from anti-HIV_CDR
  source 1..54: mol_type = other RNA
gagcagaaggactacgatttctggaacggcctgtataaatacgggatggacgtg

SEQ ID NO: 29275 - RNA, 57 nt, synthetic construct
  misc_feature 1..57: note = derived and/or modified sequence opt3 from anti-HIV_CDR
  source 1..57: mol_type = other RNA
gacaccacaactttcacgacctttggcgggggacccaacatgggtggcttcgatcct

SEQ ID NO: 29276 - RNA, 57 nt, synthetic construct
  misc_feature 1..57: note = derived and/or modified sequence opt3 from anti-HIV_CDR
  source 1..57: mol_type = other RNA
gccggcctggactacaacttctggaatgggaagggaagaaaaggtgcttttgatgtg

SEQ ID NO: 29277 - RNA, 57 nt, synthetic construct
  misc_feature 1..57: note = derived and/or modified sequence opt3 from anti-HIV_CDR
  source 1..57: mol_type = other RNA
aacgaggccgactaccacgatggcaatgggcatagcctgagaggaatgttcgactat

SEQ ID NO: 29278 - RNA, 57 nt, synthetic construct
  misc_feature 1..57: note = derived and/or modified sequence opt3 from anti-HIV_CDR
  source 1..57: mol_type = other RNA
aacgagccccagtaccacgacggcaatgggcatagcctgcctggaatgttcgattcc

SEQ ID NO: 29279 - RNA, 57 nt, synthetic construct
  misc_feature 1..57: note = derived and/or modified sequence opt3 from anti-HIV_CDR
  source 1..57: mol_type = other RNA
aacgagccccagtaccacgacgataatggccatagcctgcctgggatgatcgactat

SEQ ID NO: 29280 - RNA, 57 nt, synthetic construct
  misc_feature 1..57: note = derived and/or modified sequence opt3 from anti-HIV_CDR
  source 1..57: mol_type = other RNA
aacgagccccagtaccacgacggcaatgggcatagcctgcctggaatgttcgatttt

SEQ ID NO: 29281 - RNA, 57 nt, synthetic construct
  misc_feature 1..57: note = derived and/or modified sequence opt3 from anti-HIV_CDR
  source 1..57: mol_type = other RNA
aacgagccccagtacttcgacggcagcgggcactccctgcctggaatgtttgattat

SEQ ID NO: 29282 - RNA, 57 nt, synthetic construct
  misc_feature 1..57: note = derived and/or modified sequence opt3 from anti-HIV_CDR
  source 1..57: mol_type = other RNA
agagaggccgactaccacgatggcaacgggcataccctgcccggaatgttcgacttt

SEQ ID NO: 29283 - RNA, 57 nt, synthetic construct
  misc_feature 1..57: note = derived and/or modified sequence opt3 from anti-HIV_CDR
  source 1..57: mol_type = other RNA
aacgagccccagtactatgacggcagcgggcactccctgcctggaatgttcgattac

SEQ ID NO: 29284 - RNA, 57 nt, synthetic construct
  misc_feature 1..57: note = derived and/or modified sequence opt3 from anti-HIV_CDR
  source 1..57: mol_type = other RNA
aacgagccccagtaccacgacggcaatgggcatagcctgcctggaatgttcgattat

SEQ ID NO: 29285 - RNA, 57 nt, synthetic construct
  misc_feature 1..57: note = derived and/or modified sequence opt3 from anti-HIV_CDR
  source 1..57: mol_type = other RNA
caggacagcgatttccacgacggccatgggcacaccctgagaggaatgtttgattcc

SEQ ID NO: 29286 - RNA, 57 nt, synthetic construct
  misc_feature 1..57: note = derived and/or modified sequence opt3 from anti-HIV_CDR
  source 1..57: mol_type = other RNA
ctggactgggtgagaggcgtcatgaacctcgttgagaatcactacgccatggatgtg

SEQ ID NO: 29287 - RNA, 57 nt, synthetic construct
  misc_feature 1..57: note = derived and/or modified sequence opt3 from anti-HIV_CDR
  source 1..57: mol_type = other RNA
accaacggcacagagatcttcagacccgggggaggtgacatgagggataattggcgg

SEQ ID NO: 29288 - RNA, 57 nt, synthetic construct
  misc_feature 1..57: note = derived and/or modified sequence opt3 from anti-HIV_CDR
  source 1..57: mol_type = other RNA
gacggcagatacagcggggatgaccagtattactatcactactattacatggatgtg

SEQ ID NO: 29289 - RNA, 57 nt, synthetic construct
  misc_feature 1..57: note = derived and/or modified sequence opt3 from anti-HIV_CDR
  source 1..57: mol_type = other RNA
ctgaccaagaaccccagccaggacttctggggctcctacctctattactttgaggat

SEQ ID NO: 29290 - RNA, 57 nt, synthetic construct
  misc_feature 1..57: note = derived and/or modified sequence opt3 from anti-HIV_CDR
  source 1..57: mol_type = other RNA
ggcgccacctactattacgacagctccgggcaccagtctagaagggctttcgatatc

SEQ ID NO: 29291 - RNA, 57 nt, synthetic construct
  misc_feature 1..57: note = derived and/or modified sequence opt3 from anti-HIV_CDR
  source 1..57: mol_type = other RNA
gccttccaggctagcatggtgagaggcgtcatcgttgacccctacgggatggatgtg

SEQ ID NO: 29292 - RNA, 57 nt, synthetic construct
  misc_feature 1..57: note = derived and/or modified sequence opt3 from anti-HIV_CDR
  source 1..57: mol_type = other RNA
cacagagccgactacgatttctggaacggcagcaatctgagggggtattttgacccc

SEQ ID NO: 29293 - RNA, 57 nt, synthetic construct
  misc_feature 1..57: note = derived and/or modified sequence opt3 from anti-HIV_CDR
  source 1..57: mol_type = other RNA
cacagagccaactacgacttctggggcgggagcaatctgaggggatattttgatccc

SEQ ID NO: 29294 - RNA, 57 nt, synthetic construct
  misc_feature 1..57: note = derived and/or modified sequence opt3 from anti-HIV_CDR
  source 1..57: mol_type = other RNA
ggcttccacttttggagcgggaccggaacaagacccaggaactggtacttcgacctg

SEQ ID NO: 29295 - RNA, 57 nt, synthetic construct
  misc_feature 1..57: note = derived and/or modified sequence opt3 from anti-HIV_CDR
  source 1..57: mol_type = other RNA
aactacctgatcgagagcagatatgacgaaaaggattactattacgccatggacgtg

SEQ ID NO: 29296 - RNA, 57 nt, synthetic construct
  misc_feature 1..57: note = derived and/or modified sequence opt3 from anti-HIV_CDR
  source 1..57: mol_type = other RNA
agcagaggctacgcctatgactccgggggacactacttccccacctggtttgatcct

SEQ ID NO: 29297 - RNA, 57 nt, synthetic construct
  misc_feature 1..57: note = derived and/or modified sequence opt3 from anti-HIV_CDR
  source 1..57: mol_type = other RNA
gacaccacaactttcggcgcctttgggggaagccccaacatgggtggcctggatcct

SEQ ID NO: 29298 - RNA, 57 nt, synthetic construct
  misc_feature 1..57: note = derived and/or modified sequence opt3 from anti-HIV_CDR
  source 1..57: mol_type = other RNA
cacctggtggtcgccgttgctgcaggccccgactacttcagctatgggatggatgtg

SEQ ID NO: 29299 - RNA, 57 nt, synthetic construct
  misc_feature 1..57: note = derived and/or modified sequence opt3 from anti-HIV_CDR
  source 1..57: mol_type = other RNA
gacaccacaactttcagctcctttggctctccccctaacatgggagggctggatcca

SEQ ID NO: 29300 - RNA, 57 nt, synthetic construct
  misc_feature 1..57: note = derived and/or modified sequence opt3 from anti-HIV_CDR
  source 1..57: mol_type = other RNA
gacaccacaactttcggcgcctttgggggaggtgctaacatgggcgggctggatccc

SEQ ID NO: 29301 - RNA, 57 nt, synthetic construct
  misc_feature 1..57: note = derived and/or modified sequence opt3 from anti-HIV_CDR
  source 1..57: mol_type = other RNA
gacaccacaactttcacgagctttggctcccctcccagaatgggagggctggatcca

SEQ ID NO: 29302 - RNA, 57 nt, synthetic construct
  misc_feature 1..57: note = derived and/or modified sequence opt3 from anti-HIV_CDR
  source 1..57: mol_type = other RNA
gacaccacaactttcagctcctttggctctccccctcacatgggagggctggatcca

SEQ ID NO: 29303 - RNA, 57 nt, synthetic construct
  misc_feature 1..57: note = derived and/or modified sequence opt3 from anti-HIV_CDR
  source 1..57: mol_type = other RNA
gacagagtgagcgattacgacttctggtccggcaagagggggtatggaatggatgtc

SEQ ID NO: 29304 - RNA, 57 nt, synthetic construct
  misc_feature 1..57: note = derived and/or modified sequence opt3 from anti-HIV_CDR
  source 1..57: mol_type = other RNA
gagctgagcggcgaataccacttctggtccgggacctatagatacggagtggacgtc

SEQ ID NO: 29305 - RNA, 57 nt, synthetic construct
  misc_feature 1..57: note = derived and/or modified sequence opt3 from anti-HIV_CDR
  source 1..57: mol_type = other RNA
cacggcgccagcgagaactacgggcccggatcctattctgctgaacatttccagcac

SEQ ID NO: 29306 - RNA, 57 nt, synthetic construct
  misc_feature 1..57: note = derived and/or modified sequence opt3 from anti-HIV_CDR
  source 1..57: mol_type = other RNA
cacggcgccagcgctaactacgggcccggatcctattctgcagagcatttccagcac

SEQ ID NO: 29307 - RNA, 60 nt, synthetic construct
  misc_feature 1..60: note = derived and/or modified sequence opt3 from anti-HIV_CDR
  source 1..60: mol_type = other RNA
cacgaggcccccagatacagctatgctttcaggcggtactatcattacggcctggacgtg

SEQ ID NO: 29308 - RNA, 60 nt, synthetic construct
  misc_feature 1..60: note = derived and/or modified sequence opt3 from anti-HIV_CDR
  source 1..60: mol_type = other RNA
accagcacatacgaccagtggtccggcctgcaccatgatggggtgatggccttctcttca

SEQ ID NO: 29309 - RNA, 60 nt, synthetic construct
  misc_feature 1..60: note = derived and/or modified sequence opt3 from anti-HIV_CDR
  source 1..60: mol_type = other RNA
ggcgagttcgacagctccgggtttgattacgaatcttggtatccctactatatggacgtg

SEQ ID NO: 29310 - RNA, 60 nt, synthetic construct
  misc_feature 1..60: note = derived and/or modified sequence opt3 from anti-HIV_CDR
  source 1..60: mol_type = other RNA
ggccagaccgacctgaacgatgacttctggagcgagtactccacacccgggtttgattat

SEQ ID NO: 29311 - RNA, 60 nt, synthetic construct
  misc_feature 1..60: note = derived and/or modified sequence opt3 from anti-HIV_CDR
  source 1..60: mol_type = other RNA
ggccagaccgacctgaacgatgacctctggagcgattactccacacccgggttcgactat

SEQ ID NO: 29312 - RNA, 60 nt, synthetic construct
  misc_feature 1..60: note = derived and/or modified sequence opt3 from anti-HIV_CDR
  source 1..60: mol_type = other RNA
aacctgatcgaggaaagccagacccaacaggagattaatgaaagagacctccttgccctg

SEQ ID NO: 29313 - RNA, 60 nt, synthetic construct
  misc_feature 1..60: note = derived and/or modified sequence opt3 from anti-HIV_CDR
  source 1..60: mol_type = other RNA
aacctgatcgaggaaagccagattcaacaggagaagaatgaaaaagagctccttgaactg

SEQ ID NO: 29314 - RNA, 60 nt, synthetic construct
  misc_feature 1..60: note = derived and/or modified sequence opt3 from anti-HIV_CDR
  source 1..60: mol_type = other RNA
agcctgatcgagaactcccagattcaacaggaaaagaatgagcaggacctccttcagctg

SEQ ID NO: 29315 - RNA, 60 nt, synthetic construct
  misc_feature 1..60: note = derived and/or modified sequence opt3 from anti-HIV_CDR
  source 1..60: mol_type = other RNA
agcctgatcgaggaatcccagattcaacaggagaagaacgaaaaagagctccttgaactg

SEQ ID NO: 29316 - RNA, 60 nt, synthetic construct
  misc_feature 1..60: note = derived and/or modified sequence opt3 from anti-HIV_CDR
  source 1..60: mol_type = other RNA
agactgatcgaggaaagccagacccaacaggagaagaacgaacaggagctccttgaactg

SEQ ID NO: 29317 - RNA, 60 nt, synthetic construct
  misc_feature 1..60: note = derived and/or modified sequence opt3 from anti-HIV_CDR
  source 1..60: mol_type = other RNA
agcctgatcgaggaatcccagacccaacaggagaagaacgaaaaagagctccttgaactg

SEQ ID NO: 29318 - RNA, 60 nt, synthetic construct
  misc_feature 1..60: note = derived and/or modified sequence opt3 from anti-HIV_CDR
  source 1..60: mol_type = other RNA
aacctgctcgaggaaagccagaatcaacaggagaagaacgaacaggagcttctggaattg

SEQ ID NO: 29319 - RNA, 60 nt, synthetic construct
  misc_feature 1..60: note = derived and/or modified sequence opt3 from anti-HIV_CDR
  source 1..60: mol_type = other RNA
accctgatcgaggaaagccagaaccaacaggagaagaatgaactcgagcttctggaattg

SEQ ID NO: 29320 - RNA, 60 nt, synthetic construct
  misc_feature 1..60: note = derived and/or modified sequence opt3 from anti-HIV_CDR
  source 1..60: mol_type = other RNA
accctgcaggaggaaagccaaaaccagcaggagaagaatgaacaggagctccttgaactg

SEQ ID NO: 29321 - RNA, 60 nt, synthetic construct
  misc_feature 1..60: note = derived and/or modified sequence opt3 from anti-HIV_CDR
  source 1..60: mol_type = other RNA
agcctgctcgaggaatcccagaaccaacaggagaagaatgaacaggagcttctggaattg

SEQ ID NO: 29322 - RNA, 60 nt, synthetic construct
  misc_feature 1..60: note = derived and/or modified sequence opt3 from anti-HIV_CDR
  source 1..60: mol_type = other RNA
accctgatcgaggaaagccagaaccaacaggagaagaatcagcaggaactccttcaactg

SEQ ID NO: 29323 - RNA, 60 nt, synthetic construct
  misc_feature 1..60: note = derived and/or modified sequence opt3 from anti-HIV_CDR
  source 1..60: mol_type = other RNA
accctgatcgaggaaagccagaaccaacaggagaagaatgaacaggagctccttggcctg

SEQ ID NO: 29324 - RNA, 60 nt, synthetic construct
  misc_feature 1..60: note = derived and/or modified sequence opt3 from anti-HIV_CDR
  source 1..60: mol_type = other RNA
accctgatcgaggaaagccagaaccaacaggagaagaatgaacaggagctccttgaactg

SEQ ID NO: 29325 - RNA, 60 nt, synthetic construct
  misc_feature 1..60: note = derived and/or modified sequence opt3 from anti-HIV_CDR
  source 1..60: mol_type = other RNA
agcctgatcgaggactcccagattcaacaggaaaagaacgagaaagaactccttgagctg

SEQ ID NO: 29326 - RNA, 60 nt, synthetic construct
  misc_feature 1..60: note = derived and/or modified sequence opt3 from anti-HIV_CDR
  source 1..60: mol_type = other RNA
agcctgctcgagaagtcccagacccaacaggagaaaaacgaacaggaacttctggagttg

SEQ ID NO: 29327 - RNA, 60 nt, synthetic construct
  misc_feature 1..60: note = derived and/or modified sequence opt3 from anti-HIV_CDR
  source 1..60: mol_type = other RNA
agcctgatcgaggaatcccagaaccaacaggagaagaatgaacaggagctccttgaactg

SEQ ID NO: 29328 - RNA, 60 nt, synthetic construct
  misc_feature 1..60: note = derived and/or modified sequence opt3 from anti-HIV_CDR
  source 1..60: mol_type = other RNA
ggcgacctgctcgggtacaccgatagctggtatgagttcgactactattacatggatgtg

SEQ ID NO: 29329 - RNA, 60 nt, synthetic construct
  misc_feature 1..60: note = derived and/or modified sequence opt3 from anti-HIV_CDR
  source 1..60: mol_type = other RNA
gacaccaacggcacagagatcttcagacccgggggaggtgatatgagggacaattggcgg

SEQ ID NO: 29330 - RNA, 60 nt, synthetic construct
  misc_feature 1..60: note = derived and/or modified sequence opt3 from anti-HIV_CDR
  source 1..60: mol_type = other RNA
gacgtggtcgagagacccggcttcggggattttaggtacgactattacggaatggatgtt

SEQ ID NO: 29331 - RNA, 60 nt, synthetic construct
  misc_feature 1..60: note = derived and/or modified sequence opt3 from anti-HIV_CDR
  source 1..60: mol_type = other RNA
gaccagagagattgcagcaccaacaggtgtttcggcgtgtttgggtactatatggacgtc

SEQ ID NO: 29332 - RNA, 60 nt, synthetic construct
  misc_feature 1..60: note = derived and/or modified sequence opt3 from anti-HIV_CDR
  source 1..60: mol_type = other RNA
gacagatgggtgaggccccagttccctagcatggattttcaatacaacggcctggacgtc

SEQ ID NO: 29333 - RNA, 60 nt, synthetic construct
  misc_feature 1..60: note = derived and/or modified sequence opt3 from anti-HIV_CDR
  source 1..60: mol_type = other RNA
gacagcggcttcgatctggactactatgataccaacgagctctactttgggttcgactat

SEQ ID NO: 29334 - RNA, 60 nt, synthetic construct
  misc_feature 1..60: note = derived and/or modified sequence opt3 from anti-HIV_CDR
  source 1..60: mol_type = other RNA
aagtaccccgcctattacgacatcctgaccgctaactatagaagctactatttcgattac

SEQ ID NO: 29335 - RNA, 60 nt, synthetic construct
  misc_feature 1..60: note = derived and/or modified sequence opt3 from anti-HIV_CDR
  source 1..60: mol_type = other RNA
aagtaccccgcctattacgacatcctgaccggctattacagaaactattacttcgattat

SEQ ID NO: 29336 - RNA, 60 nt, synthetic construct
  misc_feature 1..60: note = derived and/or modified sequence opt3 from anti-HIV_CDR
  source 1..60: mol_type = other RNA
agagtgaagttccccctgtggtttggcgagaccacatactattactatgggatggacgtc

SEQ ID NO: 29337 - RNA, 60 nt, synthetic construct
  misc_feature 1..60: note = derived and/or modified sequence opt3 from anti-HIV_CDR
  source 1..60: mol_type = other RNA
gagagaagcaccaagtactccttctggtctgccgtgatgaggcccgacgcttttgatctg

SEQ ID NO: 29338 - RNA, 60 nt, synthetic construct
  misc_feature 1..60: note = derived and/or modified sequence opt3 from anti-HIV_CDR
  source 1..60: mol_type = other RNA
cacgaggcccccagatacagctatgctttcaggaactactatcattacggcctggacgtg

SEQ ID NO: 29339 - RNA, 60 nt, synthetic construct
  misc_feature 1..60: note = derived and/or modified sequence opt3 from anti-HIV_CDR
  source 1..60: mol_type = other RNA
gagaacgtgctgatggaaagcgacgattacaatgactattactattactatatggatgtc

SEQ ID NO: 29340 - RNA, 60 nt, synthetic construct
  misc_feature 1..60: note = derived and/or modified sequence opt3 from anti-HIV_CDR
  source 1..60: mol_type = other RNA
gagagagtgctggtcttccccgaccaggatgccgactattattactactttttcgatgtt

SEQ ID NO: 29341 - RNA, 60 nt, synthetic construct
  misc_feature 1..60: note = derived and/or modified sequence opt3 from anti-HIV_CDR
  source 1..60: mol_type = other RNA
gagagagtgctggtcgttcccgaccaggatgccgactactattactatttctttgatgtg

SEQ ID NO: 29342 - RNA, 63 nt, synthetic construct
  misc_feature 1..63: note = derived and/or modified sequence opt3 from anti-HIV_CDR
  source 1..63: mol_type = other RNA
gacagaagctccgccatcggctactgttcttcaattagttgctataaggggagcttcgatata

SEQ ID NO: 29343 - RNA, 63 nt, synthetic construct
  misc_feature 1..63: note = derived and/or modified sequence opt3 from anti-HIV_CDR
  source 1..63: mol_type = other RNA
gtggtcaagatcgagcccctgggcgttgcccctaccaaagctaagagagtggcaagggaaaaa

SEQ ID NO: 29344 - RNA, 63 nt, synthetic construct
  misc_feature 1..63: note = derived and/or modified sequence opt3 from anti-HIV_CDR
  source 1..63: mol_type = other RNA
gtggtcagaatcgagcccctgggcgttgcccctaccaaggctaaaagggtggaacgggagaag

SEQ ID NO: 29345 - RNA, 63 nt, synthetic construct
  misc_feature 1..63: note = derived and/or modified sequence opt3 from anti-HIV_CDR
  source 1..63: mol_type = other RNA
gtggtcagaatcgagcccctgggcattgcccctaccagggctaagcgggttgaacgcgagaaa

SEQ ID NO: 29346 - RNA, 63 nt, synthetic construct
  misc_feature 1..63: note = derived and/or modified sequence opt3 from anti-HIV_CDR
  source 1..63: mol_type = other RNA
gtggtcaagatcgagcccattggcgttgcccctaccaaagctagaagggtggaacgggagaag

SEQ ID NO: 29347 - RNA, 63 nt, synthetic construct
  misc_feature 1..63: note = derived and/or modified sequence opt3 from anti-HIV_CDR
  source 1..63: mol_type = other RNA
gtggtcaagatcgagcccctgggcgttgcccctaccagagctaaaagggtggaacgggagaag

SEQ ID NO: 29348 - RNA, 63 nt, synthetic construct
  misc_feature 1..63: note = derived and/or modified sequence opt3 from anti-HIV_CDR
  source 1..63: mol_type = other RNA
gtggtccagatcgagcccctgggcgttgcccctaccagagctaagagggtggaacgggagaaa

SEQ ID NO: 29349 - RNA, 63 nt, synthetic construct
  misc_feature 1..63: note = derived and/or modified sequence opt3 from anti-HIV_CDR
  source 1..63: mol_type = other RNA
gtggtcagaatcgagcccctgggcgttgcccctaccaaggctaaaagggtgcagcgggaaaag

SEQ ID NO: 29350 - RNA, 63 nt, synthetic construct
  misc_feature 1..63: note = derived and/or modified sequence opt3 from anti-HIV_CDR
  source 1..63: mol_type = other RNA
gtggtcaagatcgagcccctgggcgttgcccctaccaaagctaagagagtgcagaggaaaaag

SEQ ID NO: 29351 - RNA, 63 nt, synthetic construct
  misc_feature 1..63: note = derived and/or modified sequence opt3 from anti-HIV_CDR
  source 1..63: mol_type = other RNA
gtgatcaagattgagcccctgatagtcgcccctaccaaagctaagagagttcagagggaaaaa

SEQ ID NO: 29352 - RNA, 63 nt, synthetic construct
  misc_feature 1..63: note = derived and/or modified sequence opt3 from anti-HIV_CDR
  source 1..63: mol_type = other RNA
gtggtcaagatcgagcccctgggcgttgcccctaccaaagctagaagggtgcagcgggaaaag

SEQ ID NO: 29353 - RNA, 63 nt, synthetic construct
  misc_feature 1..63: note = derived and/or modified sequence opt3 from anti-HIV_CDR
  source 1..63: mol_type = other RNA
gtggtcaagatcgagctgctcggcgttgcccccaccaaagctaagagagtgcagagggaaaaa

SEQ ID NO: 29354 - RNA, 63 nt, synthetic construct
  misc_feature 1..63: note = derived and/or modified sequence opt3 from anti-HIV_CDR
  source 1..63: mol_type = other RNA
gtggtcaccatcgagcccctgggcgttgcccctacaaaggctaaaagagtgcagagggaaaag

SEQ ID NO: 29355 - RNA, 63 nt, synthetic construct
  misc_feature 1..63: note = derived and/or modified sequence opt3 from anti-HIV_CDR
  source 1..63: mol_type = other RNA
gtggtcaagatcgagcccctgggcgttgcccctaccaaagctaagagagtgcagagggaaaaa

SEQ ID NO: 29356 - RNA, 63 nt, synthetic construct
  misc_feature 1..63: note = derived and/or modified sequence opt3 from anti-HIV_CDR
  source 1..63: mol_type = other RNA
gacctggtgagcgtctcccctccctacggcaactatgggccagataataactggttcgacttt

SEQ ID NO: 29357 - RNA, 63 nt, synthetic construct
  misc_feature 1..63: note = derived and/or modified sequence opt3 from anti-HIV_CDR
  source 1..63: mol_type = other RNA
atgaatcccccttggttcagaggcgggagcaacaacccatactcctattactatatggacgtg

SEQ ID NO: 29358 - RNA, 63 nt, synthetic construct
  misc_feature 1..63: note = derived and/or modified sequence opt3 from anti-HIV_CDR
  source 1..63: mol_type = other RNA
gactggatcggctacgattatgacgggagcggatcccacctgagagatgagtctttcgacatt

SEQ ID NO: 29359 - RNA, 63 nt, synthetic construct
  misc_feature 1..63: note = derived and/or modified sequence opt3 from anti-HIV_CDR
  source 1..63: mol_type = other RNA
tgcagcatcgtgggcaacggggacttcctggaggaagattcccactaccccgccatggacgtc

SEQ ID NO: 29360 - RNA, 63 nt, synthetic construct
  misc_feature 1..63: note = derived and/or modified sequence opt3 from anti-HIV_CDR
  source 1..63: mol_type = other RNA
gacttcgtgagcatctacggcgtcgcctattttaccgggggaggtccctcctctcctgatatt

SEQ ID NO: 29361 - RNA, 66 nt, synthetic construct
  misc_feature 1..66: note = derived and/or modified sequence opt3 from anti-HIV_CDR
  source 1..66: mol_type = other RNA
aaggccaaagactactattacgagagctccgattattctccctactattactattacatggacgtg

SEQ ID NO: 29362 - RNA, 66 nt, synthetic construct
  misc_feature 1..66: note = derived and/or modified sequence opt3 from anti-HIV_CDR
  source 1..66: mol_type = other RNA
gaccacggcatcaagcccgataactactatgacattagcgggtacaatctggattatttcgactac

SEQ ID NO: 29363 - RNA, 66 nt, synthetic construct
  misc_feature 1..66: note = derived and/or modified sequence opt3 from anti-HIV_CDR
  source 1..66: mol_type = other RNA
ggcagcctgtacgactatagagataacgccgacctcaagccctcctactattacgctatggatgtg

SEQ ID NO: 29364 - RNA, 66 nt, synthetic construct
  misc_feature 1..66: note = derived and/or modified sequence opt3 from anti-HIV_CDR
  source 1..66: mol_type = other RNA
gacgaggccagctgggtggaagctgcagatgagtgggacgaacacctgttcagagagatggccgtc

SEQ ID NO: 29365 - RNA, 66 nt, synthetic construct
  misc_feature 1..66: note = derived and/or modified sequence opt3 from anti-HIV_CDR
  source 1..66: mol_type = other RNA
gacgaggtgagctgggtcgaagccgctgatgagtgggacgaacacctgttcagagagatggcagtt

SEQ ID NO: 29366 - RNA, 66 nt, synthetic construct
  misc_feature 1..66: note = derived and/or modified sequence opt3 from anti-HIV_CDR
  source 1..66: mol_type = other RNA
gacgagggcagctgggtggaagccgctgatgagtgggacgaacacctgttcagagagatggcagtc

SEQ ID NO: 29367 - RNA, 66 nt, synthetic construct
  misc_feature 1..66: note = derived and/or modified sequence opt3 from anti-HIV_CDR
  source 1..66: mol_type = other RNA
gaccagagaggcaggtacagcttcgggtttgtgaccggacaaacaaaggtctccgccatctctgat

SEQ ID NO: 29368 - RNA, 66 nt, synthetic construct
  misc_feature 1..66: note = derived and/or modified sequence opt3 from anti-HIV_CDR
  source 1..66: mol_type = other RNA
gaccagctgggcagatacagcttcgggtttgtgaccggacaaaacaaggtctccgccatctctgat

SEQ ID NO: 29369 - RNA, 66 nt, synthetic construct
  misc_feature 1..66: note = derived and/or modified sequence opt3 from anti-HIV_CDR
  source 1..66: mol_type = other RNA
gaccaggtgggcagatacagcttcgggtttgccaccggacaacagagggtctccgctatctctgat

SEQ ID NO: 29370 - RNA, 69 nt, synthetic construct
  misc_feature 1..69: note = derived and/or modified sequence opt3 from anti-HIV_CDR
  source 1..69: mol_type = other RNA
gtggtcaagatcgagcccctgggcgttgcccctaccaaagctaagagaagggtggtacagcgggaaaaa

SEQ ID NO: 29371 - RNA, 69 nt, synthetic construct
  misc_feature 1..69: note = derived and/or modified sequence opt3 from anti-HIV_CDR
  source 1..69: mol_type = other RNA
agaatcagctcctcttcatggtacatggtggacaacagtcacaccctgcatttctattacatggatgtc

SEQ ID NO: 29372 - RNA, 69 nt, synthetic construct
  misc_feature 1..69: note = derived and/or modified sequence opt3 from anti-HIV_CDR
  source 1..69: mol_type = other RNA
gacaagcccgcctacgatgagtatgctgaagagaccatcgcacctcacaactaccatgccatggacctg

SEQ ID NO: 29373 - RNA, 69 nt, synthetic construct
  misc_feature 1..69: note = derived and/or modified sequence opt3 from anti-HIV_CDR
  source 1..69: mol_type = other RNA
cagaacatcgccgctagagcagccgagaagctgtacgaaaatgactattacttctatggcatggatgtg

SEQ ID NO: 29374 - RNA, 69 nt, synthetic construct
  misc_feature 1..69: note = derived and/or modified sequence opt3 from anti-HIV_CDR
  source 1..69: mol_type = other RNA
cagaacatcgccgctagaaccgcagagaggctgtacgaaaatgactattacttctatggcatggatgtg

SEQ ID NO: 29375 - RNA, 72 nt, synthetic construct
  misc_feature 1..72: note = derived and/or modified sequence opt3 from anti-HIV_CDR
  source 1..72: mol_type = other RNA
gcccagcaaggcaagagaatctacgggattgtgagcttcggagagtttttctattactattacatggacgct

SEQ ID NO: 29376 - RNA, 72 nt, synthetic construct
  misc_feature 1..72: note = derived and/or modified sequence opt3 from anti-HIV_CDR
  source 1..72: mol_type = other RNA
acccagcaaggcaagagaatctacggggtggtcagcttcggagagtttttccactattactatatggacgcc

SEQ ID NO: 29377 - RNA, 72 nt, synthetic construct
  misc_feature 1..72: note = derived and/or modified sequence opt3 from anti-HIV_CDR
  source 1..72: mol_type = other RNA
gccagaaggggccagcggatctacggggtggtcagcttcggagagtttttctattactattccatggacgtt

SEQ ID NO: 29378 - RNA, 72 nt, synthetic construct
  misc_feature 1..72: note = derived and/or modified sequence opt3 from anti-HIV_CDR
  source 1..72: mol_type = other RNA
accctgcacggcagaaggatctacgggattgtggccttcaacgagtggtttacatatttctacatggacgtc

SEQ ID NO: 29379 - RNA, 72 nt, synthetic construct
  misc_feature 1..72: note = derived and/or modified sequence opt3 from anti-HIV_CDR
  source 1..72: mol_type = other RNA
accaagcacggcagaaggatctacgggattgtggccttcaacgagtggtttacatatttctacatggacgtc

SEQ ID NO: 29380 - RNA, 72 nt, synthetic construct
  misc_feature 1..72: note = derived and/or modified sequence opt3 from anti-HIV_CDR
  source 1..72: mol_type = other RNA
gccagacacggccagaggatctacggggtggtcagcttcggagagtttttcacctattactccatggacgtt

SEQ ID NO: 29381 - RNA, 72 nt, synthetic construct
  misc_feature 1..72: note = derived and/or modified sequence opt3 from anti-HIV_CDR
  source 1..72: mol_type = other RNA
acccagcaaggcaagagaatctacggggtggtcagcttcggagactattactattactattacatggatgtt

SEQ ID NO: 29382 - RNA, 72 nt, synthetic construct
  misc_feature 1..72: note = derived and/or modified sequence opt3 from anti-HIV_CDR
  source 1..72: mol_type = other RNA
accaagcacggcagaaggatctacggggtggtcgccttcggagagtggtttacatatttctacatggacgtt

SEQ ID NO: 29383 - RNA, 72 nt, synthetic construct
  misc_feature 1..72: note = derived and/or modified sequence opt3 from anti-HIV_CDR
  source 1..72: mol_type = other RNA
gccgtgatcaccgacctgcacacattcggcgattacgagctcgaagaccccagctattactatatggatgtc

SEQ ID NO: 29384 - RNA, 72 nt, synthetic construct
  misc_feature 1..72: note = derived and/or modified sequence opt3 from anti-HIV_CDR
  source 1..72: mol_type = other RNA
gacagaggcgataccaggctgctcgactacggggattatgaggacgaacggtactattacggaatggatgtg

SEQ ID NO: 29385 - RNA, 72 nt, synthetic construct
  misc_feature 1..72: note = derived and/or modified sequence opt3 from anti-HIV_CDR
  source 1..72: mol_type = other RNA
ggcaccagatacgacttctggagcgggttttccaacagggatggacgggccctggctggttatttcgactac

SEQ ID NO: 29386 - RNA, 72 nt, synthetic construct
  misc_feature 1..72: note = derived and/or modified sequence opt3 from anti-HIV_CDR
  source 1..72: mol_type = other RNA
gacggcaaggggaaagcctactatgatttctggagcggatacagaaaccagaagtattacggtctggacgtg

SEQ ID NO: 29387 - RNA, 72 nt, synthetic construct
  misc_feature 1..72: note = derived and/or modified sequence opt3 from anti-HIV_CDR
  source 1..72: mol_type = other RNA
gccgtgatcaccgacctgcacacattcgctgattacgagctcggcgaccccagctatttttacatggatgtc

SEQ ID NO: 29388 - RNA, 72 nt, synthetic construct
  misc_feature 1..72: note = derived and/or modified sequence opt3 from anti-HIV_CDR
  source 1..72: mol_type = other RNA
agcgtgatcaccgacctgcacacattcggcgattacgagtccggggacccctcttattactatatggatgtc

SEQ ID NO: 29389 - RNA, 81 nt, synthetic construct
  misc_feature 1..81: note = derived and/or modified sequence opt3 from anti-HIV_CDR
  source 1..81: mol_type = other RNA
gacttccccagatttcacaggctggtgggcaactacgatttctggcgggggaccctcgaccgctttagctatatggatctt

SEQ ID NO: 29390 - RNA, 105 nt, synthetic construct
  misc_feature 1..105: note = derived and/or modified sequence opt3 from anti-HIV_CDR
  source 1..105: mol_type = other RNA
agaatcctggccgtggagaggtacctcaaggaccagcaacttctgggcatttgggggtgcagcggaaaaataatctgtcccaccatggtcccttggaactcctct

SEQ ID NO: 29391 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctccaggaccaacggcttctgggcatgtgggggtgcagcggaaagcacatctgtaccacattcgttccctggaactcctct

SEQ ID NO: 29392 - RNA, 105 nt, synthetic construct
  misc_feature 1..105: note = derived and/or modified sequence opt3 from anti-HIV_CDR
  source 1..105: mol_type = other RNA
agagtgctggccgtcgagagctacctcaaggaccagcaacttctgggcatctgggggtgctccggaaaacacatttgtaccacaactgttccctggaactcttca

SEQ ID NO: 29393 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctccgggaccagcaacttctgggcatctgggggtgcagcggacgccacatttgtaccacaaatgttccctggaactcctct

SEQ ID NO: 29394 - RNA, 105 nt, synthetic construct
  misc_feature 1..105: note = derived and/or modified sequence opt3 from anti-HIV_CDR
  source 1..105: mol_type = other RNA
agaatcctggccgtggagaggtacctcaaggaccagcaacttctgggcatttgggggtgcagcggaaaattgatatgtaccacaactgtcccctggaactcctct

SEQ ID NO: 29395 - RNA, 105 nt, synthetic construct
  misc_feature 1..105: note = derived and/or modified sequence opt3 from anti-HIV_CDR
  source 1..105: mol_type = other RNA
agaatcctggccgtggagaggtacctcaaggaccagcaacttctgggcatttgggggtgcagcggaaaacacatatgtaccacaaatgtcccctggaactcctct

SEQ ID NO: 29396 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctccgggaccagcaacttctgggcatctgggggtgcagcggaaagttgatttgtaccacaactgttccctggaacgcttcc

SEQ ID NO: 29397 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctccgggaccagcaacttctgggcatctgggggtgcagcggaaagttgatttgtaccacagctgttccctggaacgcatcc

SEQ ID NO: 29398 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctcaaggaccagcaacttctgggcatctgggggtgcagcggaaaattgatttgtaccacaactgttccctggaacgcttcc

SEQ ID NO: 29399 - RNA, 105 nt, synthetic construct
  misc_feature 1..105: note = derived and/or modified sequence opt3 from anti-HIV_CDR
  source 1..105: mol_type = other RNA
agaatcctggccgtggagaggtacctcaaggaccagcaacttctgggcttctgggggtgcagcggaaaattgatttgtaccacagctgtcccctggaacgcatcc

SEQ ID NO: 29400 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctccgggaccagcaacttctgggcatctgggggtgcagcggaaagttgatttgtaccacaactgttccctggaacacgtcc

SEQ ID NO: 29401 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctcaaggaccagcaacttctgggcatctgggggtgcagcggaaaattgatttgtaccacagctgttccctggaacgcatcc

SEQ ID NO: 29402 - RNA, 105 nt, synthetic construct
  misc_feature 1..105: note = derived and/or modified sequence opt3 from anti-HIV_CDR
  source 1..105: mol_type = other RNA
agagtgctggccgtcgagaggtacctcaaggaccagcaacttctgggcttctgggggtgcagcggaaaattgatctgtaccacaactgttccctggaacgcttcc

SEQ ID NO: 29403 - RNA, 105 nt, synthetic construct
  misc_feature 1..105: note = derived and/or modified sequence opt3 from anti-HIV_CDR
  source 1..105: mol_type = other RNA
agaatcctggccgtggagaggtacctcaaggaccagcaacttctgggcatttgggggtgcagcggaaaattgatatgtaccacagctgtcccctggaacgcatcc

SEQ ID NO: 29404-29429 - skipped (26 entries)

SEQ ID NO: 29430 - RNA, 12 nt, synthetic construct
  misc_feature 1..12: note = derived and/or modified sequence opt3 from anti-influenza_CDR
  source 1..12: mol_type = other RNA
gacgtgcccgat

SEQ ID NO: 29431 - RNA, 12 nt, synthetic construct
  misc_feature 1..12: note = derived and/or modified sequence opt3 from anti-influenza_CDR
  source 1..12: mol_type = other RNA
agactgagcggc

SEQ ID NO: 29432 - RNA, 12 nt, synthetic construct
  misc_feature 1..12: note = derived and/or modified sequence opt3 from anti-influenza_CDR
  source 1..12: mol_type = other RNA
ttctgggacctg

SEQ ID NO: 29433 - RNA, 15 nt, synthetic construct
  misc_feature 1..15: note = derived and/or modified sequence opt3 from anti-influenza_CDR
  source 1..15: mol_type = other RNA
accggcctgagaaac

SEQ ID NO: 29434 - RNA, 15 nt, synthetic construct
  misc_feature 1..15: note = derived and/or modified sequence opt3 from anti-influenza_CDR
  source 1..15: mol_type = other RNA
cagcaaagcagaacc

SEQ ID NO: 29435 - RNA, 15 nt, synthetic construct
  misc_feature 1..15: note = derived and/or modified sequence opt3 from anti-influenza_CDR
  source 1..15: mol_type = other RNA
cagctgagcagaacc

SEQ ID NO: 29436 - RNA, 15 nt, synthetic construct
  misc_feature 1..15: note = derived and/or modified sequence opt3 from anti-influenza_CDR
  source 1..15: mol_type = other RNA
agcaactacatcacc

SEQ ID NO: 29437 - RNA, 15 nt, synthetic construct
  misc_feature 1..15: note = derived and/or modified sequence opt3 from anti-influenza_CDR
  source 1..15: mol_type = other RNA
gactacagctggaac

SEQ ID NO: 29438 - RNA, 15 nt, synthetic construct
  misc_feature 1..15: note = derived and/or modified sequence opt3 from anti-influenza_CDR
  source 1..15: mol_type = other RNA
aactacgccttcagc

SEQ ID NO: 29439 - RNA, 15 nt, synthetic construct
  misc_feature 1..15: note = derived and/or modified sequence opt3 from anti-influenza_CDR
  source 1..15: mol_type = other RNA
aagaacgccatcagc

SEQ ID NO: 29440 - RNA, 15 nt, synthetic construct
  misc_feature 1..15: note = derived and/or modified sequence opt3 from anti-influenza_CDR
  source 1..15: mol_type = other RNA
agccactggatgacc

SEQ ID NO: 29441 - RNA, 15 nt, synthetic construct
  misc_feature 1..15: note = derived and/or modified sequence opt3 from anti-influenza_CDR
  source 1..15: mol_type = other RNA
aactacgacatcaat

SEQ ID NO: 29442 - RNA, 15 nt, synthetic construct
  misc_feature 1..15: note = derived and/or modified sequence opt3 from anti-influenza_CDR
  source 1..15: mol_type = other RNA
gactacggcgtgacc

SEQ ID NO: 29443 - RNA, 15 nt, synthetic construct
  misc_feature 1..15: note = derived and/or modified sequence opt3 from anti-influenza_CDR
  source 1..15: mol_type = other RNA
aactacggcatcaat

SEQ ID NO: 29444 - RNA, 15 nt, synthetic construct
  misc_feature 1..15: note = derived and/or modified sequence opt3 from anti-influenza_CDR
  source 1..15: mol_type = other RNA
ggctacaccatcaca

SEQ ID NO: 29445 - RNA, 15 nt, synthetic construct
  misc_feature 1..15: note = derived and/or modified sequence opt3 from anti-influenza_CDR
  source 1..15: mol_type = other RNA
aactacggcatcagc

SEQ ID NO: 29446 - RNA, 15 nt, synthetic construct
  misc_feature 1..15: note = derived and/or modified sequence opt3 from anti-influenza_CDR
  source 1..15: mol_type = other RNA
gacgattactggacc

SEQ ID NO: 29447 - RNA, 15 nt, synthetic construct
  misc_feature 1..15: note = derived and/or modified sequence opt3 from anti-influenza_CDR
  source 1..15: mol_type = other RNA
acctacgccatgcac

SEQ ID NO: 29448 - RNA, 15 nt, synthetic construct
  misc_feature 1..15: note = derived and/or modified sequence opt3 from anti-influenza_CDR
  source 1..15: mol_type = other RNA
agctacgccatgcac

SEQ ID NO: 29449 - RNA, 15 nt, synthetic construct
  misc_feature 1..15: note = derived and/or modified sequence opt3 from anti-influenza_CDR
  source 1..15: mol_type = other RNA
agctactattggaac

SEQ ID NO: 29450 - RNA, 15 nt, synthetic construct
  misc_feature 1..15: note = derived and/or modified sequence opt3 from anti-influenza_CDR
  source 1..15: mol_type = other RNA
acctaccccgtggcc

SEQ ID NO: 29451 - RNA, 15 nt, synthetic construct
  misc_feature 1..15: note = derived and/or modified sequence opt3 from anti-influenza_CDR
  source 1..15: mol_type = other RNA
cactacttctggagc

SEQ ID NO: 29452 - RNA, 15 nt, synthetic construct
  misc_feature 1..15: note = derived and/or modified sequence opt3 from anti-influenza_CDR
  source 1..15: mol_type = other RNA
gactactattggacc

SEQ ID NO: 29453 - RNA, 15 nt, synthetic construct
  misc_feature 1..15: note = derived and/or modified sequence opt3 from anti-influenza_CDR
  source 1..15: mol_type = other RNA
gactactattggagc

SEQ ID NO: 29454 - RNA, 15 nt, synthetic construct
  misc_feature 1..15: note = derived and/or modified sequence opt3 from anti-influenza_CDR
  source 1..15: mol_type = other RNA
ggctactatatgcac

SEQ ID NO: 29455 - RNA, 15 nt, synthetic construct
  misc_feature 1..15: note = derived and/or modified sequence opt3 from anti-influenza_CDR
  source 1..15: mol_type = other RNA
agccactactggtcc

SEQ ID NO: 29456 - RNA, 15 nt, synthetic construct
  misc_feature 1..15: note = derived and/or modified sequence opt3 from anti-influenza_CDR
  source 1..15: mol_type = other RNA
aactactggatcggc

SEQ ID NO: 29457 - RNA, 15 nt, synthetic construct
  misc_feature 1..15: note = derived and/or modified sequence opt3 from anti-influenza_CDR
  source 1..15: mol_type = other RNA
aactacgccatcatt

SEQ ID NO: 29458 - RNA, 15 nt, synthetic construct
  misc_feature 1..15: note = derived and/or modified sequence opt3 from anti-influenza_CDR
  source 1..15: mol_type = other RNA
gactactatatccac

SEQ ID NO: 29459 - RNA, 15 nt, synthetic construct
  misc_feature 1..15: note = derived and/or modified sequence opt3 from anti-influenza_CDR
  source 1..15: mol_type = other RNA
ggctacgacatgcac

SEQ ID NO: 29460 - RNA, 15 nt, synthetic construct
  misc_feature 1..15: note = derived and/or modified sequence opt3 from anti-influenza_CDR
  source 1..15: mol_type = other RNA
ggctactatatccac

SEQ ID NO: 29461 - RNA, 15 nt, synthetic construct
  misc_feature 1..15: note = derived and/or modified sequence opt3 from anti-influenza_CDR
  source 1..15: mol_type = other RNA
ggctactatgtgcac

SEQ ID NO: 29462 - RNA, 15 nt, synthetic construct
  misc_feature 1..15: note = derived and/or modified sequence opt3 from anti-influenza_CDR
  source 1..15: mol_type = other RNA
aactactggatgagc

SEQ ID NO: 29463 - RNA, 15 nt, synthetic construct
  misc_feature 1..15: note = derived and/or modified sequence opt3 from anti-influenza_CDR
  source 1..15: mol_type = other RNA
ggcgagagcaccctg

SEQ ID NO: 29464 - RNA, 15 nt, synthetic construct
  misc_feature 1..15: note = derived and/or modified sequence opt3 from anti-influenza_CDR
  source 1..15: mol_type = other RNA
aactactattggagc

SEQ ID NO: 29465 - RNA, 15 nt, synthetic construct
  misc_feature 1..15: note = derived and/or modified sequence opt3 from anti-influenza_CDR
  source 1..15: mol_type = other RNA
agcaactacatgtcc

SEQ ID NO: 29466 - RNA, 15 nt, synthetic construct
  misc_feature 1..15: note = derived and/or modified sequence opt3 from anti-influenza_CDR
  source 1..15: mol_type = other RNA
agcgactactggtcc

SEQ ID NO: 29467 - RNA, 15 nt, synthetic construct
  misc_feature 1..15: note = derived and/or modified sequence opt3 from anti-influenza_CDR
  source 1..15: mol_type = other RNA
agctacaactggatc

SEQ ID NO: 29468 - RNA, 15 nt, synthetic construct
  misc_feature 1..15: note = derived and/or modified sequence opt3 from anti-influenza_CDR
  source 1..15: mol_type = other RNA
agcacctacatgaac

SEQ ID NO: 29469 - RNA, 15 nt, synthetic construct
  misc_feature 1..15: note = derived and/or modified sequence opt3 from anti-influenza_CDR
  source 1..15: mol_type = other RNA
aactacgccatgagc

SEQ ID NO: 29470 - RNA, 15 nt, synthetic construct
  misc_feature 1..15: note = derived and/or modified sequence opt3 from anti-influenza_CDR
  source 1..15: mol_type = other RNA
agcgacttctggtcc

SEQ ID NO: 29471 - RNA, 15 nt, synthetic construct
  misc_feature 1..15: note = derived and/or modified sequence opt3 from anti-influenza_CDR
  source 1..15: mol_type = other RNA
tactatgccatgagc

SEQ ID NO: 29472 - RNA, 15 nt, synthetic construct
  misc_feature 1..15: note = derived and/or modified sequence opt3 from anti-influenza_CDR
  source 1..15: mol_type = other RNA
ggctactatgtgtac

SEQ ID NO: 29473 - RNA, 15 nt, synthetic construct
  misc_feature 1..15: note = derived and/or modified sequence opt3 from anti-influenza_CDR
  source 1..15: mol_type = other RNA
agctacgccatctcc

SEQ ID NO: 29474 - RNA, 15 nt, synthetic construct
  misc_feature 1..15: note = derived and/or modified sequence opt3 from anti-influenza_CDR
  source 1..15: mol_type = other RNA
agctactcctggtct

SEQ ID NO: 29475 - RNA, 15 nt, synthetic construct
  misc_feature 1..15: note = derived and/or modified sequence opt3 from anti-influenza_CDR
  source 1..15: mol_type = other RNA
aacagcttctggggc

SEQ ID NO: 29476 - RNA, 15 nt, synthetic construct
  misc_feature 1..15: note = derived and/or modified sequence opt3 from anti-influenza_CDR
  source 1..15: mol_type = other RNA
gcctaccactggagc

SEQ ID NO: 29477 - RNA, 15 nt, synthetic construct
  misc_feature 1..15: note = derived and/or modified sequence opt3 from anti-influenza_CDR
  source 1..15: mol_type = other RNA
gacaactacatcaat

SEQ ID NO: 29478 - RNA, 15 nt, synthetic construct
  misc_feature 1..15: note = derived and/or modified sequence opt3 from anti-influenza_CDR
  source 1..15: mol_type = other RNA
agcggcttctccgtg

SEQ ID NO: 29479 - RNA, 15 nt, synthetic construct
  misc_feature 1..15: note = derived and/or modified sequence opt3 from anti-influenza_CDR
  source 1..15: mol_type = other RNA
gcctacgctttcacc

SEQ ID NO: 29480 - RNA, 15 nt, synthetic construct
  misc_feature 1..15: note = derived and/or modified sequence opt3 from anti-influenza_CDR
  source 1..15: mol_type = other RNA
ggcagcgccatctcc

SEQ ID NO: 29481 - RNA, 15 nt, synthetic construct
  misc_feature 1..15: note = derived and/or modified sequence opt3 from anti-influenza_CDR
  source 1..15: mol_type = other RNA
agctacgccatcacc

SEQ ID NO: 29482 - RNA, 15 nt, synthetic construct
  misc_feature 1..15: note = derived and/or modified sequence opt3 from anti-influenza_CDR
  source 1..15: mol_type = other RNA
agctactatatgcac

SEQ ID NO: 29483 - RNA, 15 nt, synthetic construct
  misc_feature 1..15: note = derived and/or modified sequence opt3 from anti-influenza_CDR
  source 1..15: mol_type = other RNA
atctacgccatgagc

SEQ ID NO: 29484 - RNA, 15 nt, synthetic construct
  misc_feature 1..15: note = derived and/or modified sequence opt3 from anti-influenza_CDR
  source 1..15: mol_type = other RNA
agctactccatgaac

SEQ ID NO: 29485 - RNA, 15 nt, synthetic construct
  misc_feature 1..15: note = derived and/or modified sequence opt3 from anti-influenza_CDR
  source 1..15: mol_type = other RNA
agctacggcatctcc

SEQ ID NO: 29486 - RNA, 15 nt, synthetic construct
  misc_feature 1..15: note = derived and/or modified sequence opt3 from anti-influenza_CDR
  source 1..15: mol_type = other RNA
ttctacagcatgtcc

SEQ ID NO: 29487 - RNA, 15 nt, synthetic construct
  misc_feature 1..15: note = derived and/or modified sequence opt3 from anti-influenza_CDR
  source 1..15: mol_type = other RNA
acccacgccatcagc

SEQ ID NO: 29488 - RNA, 15 nt, synthetic construct
  misc_feature 1..15: note = derived and/or modified sequence opt3 from anti-influenza_CDR
  source 1..15: mol_type = other RNA
ggctacgccatcagc

SEQ ID NO: 29489 - RNA, 15 nt, synthetic construct
  misc_feature 1..15: note = derived and/or modified sequence opt3 from anti-influenza_CDR
  source 1..15: mol_type = other RNA
agcaactccatctct

SEQ ID NO: 29490 - RNA, 15 nt, synthetic construct
  misc_feature 1..15: note = derived and/or modified sequence opt3 from anti-influenza_CDR
  source 1..15: mol_type = other RNA
aacttcgccatcaat

SEQ ID NO: 29491 - RNA, 15 nt, synthetic construct
  misc_feature 1..15: note = derived and/or modified sequence opt3 from anti-influenza_CDR
  source 1..15: mol_type = other RNA
agcaacgccgtgtcc

SEQ ID NO: 29492 - RNA, 15 nt, synthetic construct
  misc_feature 1..15: note = derived and/or modified sequence opt3 from anti-influenza_CDR
  source 1..15: mol_type = other RNA
gacaacgccatcagc

SEQ ID NO: 29493 - RNA, 15 nt, synthetic construct
  misc_feature 1..15: note = derived and/or modified sequence opt3 from anti-influenza_CDR
  source 1..15: mol_type = other RNA
ttcagcgaggtggaa

SEQ ID NO: 29494 - RNA, 15 nt, synthetic construct
  misc_feature 1..15: note = derived and/or modified sequence opt3 from anti-influenza_CDR
  source 1..15: mol_type = other RNA
gcccaccatatgcac

SEQ ID NO: 29495 - RNA, 15 nt, synthetic construct
  misc_feature 1..15: note = derived and/or modified sequence opt3 from anti-influenza_CDR
  source 1..15: mol_type = other RNA
agccagtggatcggc

SEQ ID NO: 29496 - RNA, 15 nt, synthetic construct
  misc_feature 1..15: note = derived and/or modified sequence opt3 from anti-influenza_CDR
  source 1..15: mol_type = other RNA
gactacgccatgaac

SEQ ID NO: 29497 - RNA, 15 nt, synthetic construct
  misc_feature 1..15: note = derived and/or modified sequence opt3 from anti-influenza_CDR
  source 1..15: mol_type = other RNA
aacgcctggatgagc

SEQ ID NO: 29498 - RNA, 15 nt, synthetic construct
  misc_feature 1..15: note = derived and/or modified sequence opt3 from anti-influenza_CDR
  source 1..15: mol_type = other RNA
gactacgccatcaac

SEQ ID NO: 29499 - RNA, 15 nt, synthetic construct
  misc_feature 1..15: note = derived and/or modified sequence opt3 from anti-influenza_CDR
  source 1..15: mol_type = other RNA
agacacggcatcagc

SEQ ID NO: 29500 - RNA, 15 nt, synthetic construct
  misc_feature 1..15: note = derived and/or modified sequence opt3 from anti-influenza_CDR
  source 1..15: mol_type = other RNA
gagctgagcatccac

SEQ ID NO: 29501 - RNA, 15 nt, synthetic construct
  misc_feature 1..15: note = derived and/or modified sequence opt3 from anti-influenza_CDR
  source 1..15: mol_type = other RNA
agctccaactactat

SEQ ID NO: 29502 - RNA, 15 nt, synthetic construct
  misc_feature 1..15: note = derived and/or modified sequence opt3 from anti-influenza_CDR
  source 1..15: mol_type = other RNA
acctacgccatgagc

SEQ ID NO: 29503 - RNA, 15 nt, synthetic construct
  misc_feature 1..15: note = derived and/or modified sequence opt3 from anti-influenza_CDR
  source 1..15: mol_type = other RNA
aactacgccatcagc

SEQ ID NO: 29504 - RNA, 18 nt, synthetic construct
  misc_feature 1..18: note = derived and/or modified sequence opt3 from anti-influenza_CDR
  source 1..18: mol_type = other RNA
ttcggcgccatcgctggg

SEQ ID NO: 29505 - RNA, 18 nt, synthetic construct
  misc_feature 1..18: note = derived and/or modified sequence opt3 from anti-influenza_CDR
  source 1..18: mol_type = other RNA
caggacatcagcagatac

SEQ ID NO: 29506 - RNA, 18 nt, synthetic construct
  misc_feature 1..18: note = derived and/or modified sequence opt3 from anti-influenza_CDR
  source 1..18: mol_type = other RNA
cagaacatcggcccctgg

SEQ ID NO: 29507 - RNA, 18 nt, synthetic construct
  misc_feature 1..18: note = derived and/or modified sequence opt3 from anti-influenza_CDR
  source 1..18: mol_type = other RNA
cagagcgtgaacagaagg

SEQ ID NO: 29508 - RNA, 18 nt, synthetic construct
  misc_feature 1..18: note = derived and/or modified sequence opt3 from anti-influenza_CDR
  source 1..18: mol_type = other RNA
cagagcatctccacctac

SEQ ID NO: 29509 - RNA, 18 nt, synthetic construct
  misc_feature 1..18: note = derived and/or modified sequence opt3 from anti-influenza_CDR
  source 1..18: mol_type = other RNA
cagggcatcattacctac

SEQ ID NO: 29510 - RNA, 18 nt, synthetic construct
  misc_feature 1..18: note = derived and/or modified sequence opt3 from anti-influenza_CDR
  source 1..18: mol_type = other RNA
cagggcatcagctcctac

SEQ ID NO: 29511 - RNA, 18 nt, synthetic construct
  misc_feature 1..18: note = derived and/or modified sequence opt3 from anti-influenza_CDR
  source 1..18: mol_type = other RNA
caggacgtgagcacctgg

SEQ ID NO: 29512 - RNA, 18 nt, synthetic construct
  misc_feature 1..18: note = derived and/or modified sequence opt3 from anti-influenza_CDR
  source 1..18: mol_type = other RNA
caggacatctacatttat

SEQ ID NO: 29513 - RNA, 18 nt, synthetic construct
  misc_feature 1..18: note = derived and/or modified sequence opt3 from anti-influenza_CDR
  source 1..18: mol_type = other RNA
gagaacatctggaataac

SEQ ID NO: 29514 - RNA, 18 nt, synthetic construct
  misc_feature 1..18: note = derived and/or modified sequence opt3 from anti-influenza_CDR
  source 1..18: mol_type = other RNA
ggcttcaccgtgacaagc

SEQ ID NO: 29515 - RNA, 18 nt, synthetic construct
  misc_feature 1..18: note = derived and/or modified sequence opt3 from anti-influenza_CDR
  source 1..18: mol_type = other RNA
caggacatcagcggccac

SEQ ID NO: 29516 - RNA, 18 nt, synthetic construct
  misc_feature 1..18: note = derived and/or modified sequence opt3 from anti-influenza_CDR
  source 1..18: mol_type = other RNA
agcctgctcaccgaggtg

SEQ ID NO: 29517 - RNA, 18 nt, synthetic construct
  misc_feature 1..18: note = derived and/or modified sequence opt3 from anti-influenza_CDR
  source 1..18: mol_type = other RNA
ggcagctccatctctaac

SEQ ID NO: 29518 - RNA, 18 nt, synthetic construct
  misc_feature 1..18: note = derived and/or modified sequence opt3 from anti-influenza_CDR
  source 1..18: mol_type = other RNA
ggcgggagcatcacctcc

SEQ ID NO: 29519 - RNA, 18 nt, synthetic construct
  misc_feature 1..18: note = derived and/or modified sequence opt3 from anti-influenza_CDR
  source 1..18: mol_type = other RNA
ggcgggagcatctcctct

SEQ ID NO: 29520 - RNA, 18 nt, synthetic construct
  misc_feature 1..18: note = derived and/or modified sequence opt3 from anti-influenza_CDR
  source 1..18: mol_type = other RNA
ggcctgagcgtgtcctct

SEQ ID NO: 29521 - RNA, 18 nt, synthetic construct
  misc_feature 1..18: note = derived and/or modified sequence opt3 from anti-influenza_CDR
  source 1..18: mol_type = other RNA
ggcgccagcatctcctct

SEQ ID NO: 29522 - RNA, 18 nt, synthetic construct
  misc_feature 1..18: note = derived and/or modified sequence opt3 from anti-influenza_CDR
  source 1..18: mol_type = other RNA
ggcgacagcatctcctct

SEQ ID NO: 29523 - RNA, 18 nt, synthetic construct
  misc_feature 1..18: note = derived and/or modified sequence opt3 from anti-influenza_CDR
  source 1..18: mol_type = other RNA
ggcgggagcatctccaac

SEQ ID NO: 29524 - RNA, 18 nt, synthetic construct
  misc_feature 1..18: note = derived and/or modified sequence opt3 from anti-influenza_CDR
  source 1..18: mol_type = other RNA
ggcgggagcatctccgcc

SEQ ID NO: 29525 - RNA, 18 nt, synthetic construct
  misc_feature 1..18: note = derived and/or modified sequence opt3 from anti-influenza_CDR
  source 1..18: mol_type = other RNA
ggcttcagcgtgtccgac

SEQ ID NO: 29526 - RNA, 18 nt, synthetic construct
  misc_feature 1..18: note = derived and/or modified sequence opt3 from anti-influenza_CDR
  source 1..18: mol_type = other RNA
agcagatccctggacgtg

SEQ ID NO: 29527 - RNA, 18 nt, synthetic construct
  misc_feature 1..18: note = derived and/or modified sequence opt3 from anti-influenza_CDR
  source 1..18: mol_type = other RNA
agaagccagcaaaccgtg

SEQ ID NO: 29528 - RNA, 18 nt, synthetic construct
  misc_feature 1..18: note = derived and/or modified sequence opt3 from anti-influenza_CDR
  source 1..18: mol_type = other RNA
cagaccatcaacaattac

SEQ ID NO: 29529 - RNA, 18 nt, synthetic construct
  misc_feature 1..18: note = derived and/or modified sequence opt3 from anti-influenza_CDR
  source 1..18: mol_type = other RNA
aacatgggccccaccagc

SEQ ID NO: 29530 - RNA, 18 nt, synthetic construct
  misc_feature 1..18: note = derived and/or modified sequence opt3 from anti-influenza_CDR
  source 1..18: mol_type = other RNA
caggtggtcggcaccaac

SEQ ID NO: 29531 - RNA, 18 nt, synthetic construct
  misc_feature 1..18: note = derived and/or modified sequence opt3 from anti-influenza_CDR
  source 1..18: mol_type = other RNA
cagggcatcaacacccac

SEQ ID NO: 29532 - RNA, 18 nt, synthetic construct
  misc_feature 1..18: note = derived and/or modified sequence opt3 from anti-influenza_CDR
  source 1..18: mol_type = other RNA
caggacatcagaaacagg

SEQ ID NO: 29533 - RNA, 18 nt, synthetic construct
  misc_feature 1..18: note = derived and/or modified sequence opt3 from anti-influenza_CDR
  source 1..18: mol_type = other RNA
cagggcatcgggagcaac

SEQ ID NO: 29534 - RNA, 18 nt, synthetic construct
  misc_feature 1..18: note = derived and/or modified sequence opt3 from anti-influenza_CDR
  source 1..18: mol_type = other RNA
cagaccatctacagatgg

SEQ ID NO: 29535 - RNA, 18 nt, synthetic construct
  misc_feature 1..18: note = derived and/or modified sequence opt3 from anti-influenza_CDR
  source 1..18: mol_type = other RNA
cagaccatcacaagattc

SEQ ID NO: 29536 - RNA, 18 nt, synthetic construct
  misc_feature 1..18: note = derived and/or modified sequence opt3 from anti-influenza_CDR
  source 1..18: mol_type = other RNA
agactgggcgagaagttc

SEQ ID NO: 29537 - RNA, 18 nt, synthetic construct
  misc_feature 1..18: note = derived and/or modified sequence opt3 from anti-influenza_CDR
  source 1..18: mol_type = other RNA
aagctgggcgacaaattc

SEQ ID NO: 29538 - RNA, 18 nt, synthetic construct
  misc_feature 1..18: note = derived and/or modified sequence opt3 from anti-influenza_CDR
  source 1..18: mol_type = other RNA
cagggcctggggagcaac

SEQ ID NO: 29539 - RNA, 18 nt, synthetic construct
  misc_feature 1..18: note = derived and/or modified sequence opt3 from anti-influenza_CDR
  source 1..18: mol_type = other RNA
tacatcggcagcaagtcc

SEQ ID NO: 29540 - RNA, 18 nt, synthetic construct
  misc_feature 1..18: note = derived and/or modified sequence opt3 from anti-influenza_CDR
  source 1..18: mol_type = other RNA
cagctgatcagctcctac

SEQ ID NO: 29541 - RNA, 18 nt, synthetic construct
  misc_feature 1..18: note = derived and/or modified sequence opt3 from anti-influenza_CDR
  source 1..18: mol_type = other RNA
cagagcgtgtcctctaac

SEQ ID NO: 29542 - RNA, 18 nt, synthetic construct
  misc_feature 1..18: note = derived and/or modified sequence opt3 from anti-influenza_CDR
  source 1..18: mol_type = other RNA
caggtgatcagctcctac

SEQ ID NO: 29543 - RNA, 18 nt, synthetic construct
  misc_feature 1..18: note = derived and/or modified sequence opt3 from anti-influenza_CDR
  source 1..18: mol_type = other RNA
cagagcgtgaacagaaat

SEQ ID NO: 29544 - RNA, 18 nt, synthetic construct
  misc_feature 1..18: note = derived and/or modified sequence opt3 from anti-influenza_CDR
  source 1..18: mol_type = other RNA
gacatcggcagcaagtcc

SEQ ID NO: 29545 - RNA, 18 nt, synthetic construct
  misc_feature 1..18: note = derived and/or modified sequence opt3 from anti-influenza_CDR
  source 1..18: mol_type = other RNA
cagagcgtgtccaccaac

SEQ ID NO: 29546 - RNA, 18 nt, synthetic construct
  misc_feature 1..18: note = derived and/or modified sequence opt3 from anti-influenza_CDR
  source 1..18: mol_type = other RNA
atgatcgccggctggcac

SEQ ID NO: 29547 - RNA, 18 nt, synthetic construct
  misc_feature 1..18: note = derived and/or modified sequence opt3 from anti-influenza_CDR
  source 1..18: mol_type = other RNA
caggacatcagcacctgg

SEQ ID NO: 29548 - RNA, 18 nt, synthetic construct
  misc_feature 1..18: note = derived and/or modified sequence opt3 from anti-influenza_CDR
  source 1..18: mol_type = other RNA
gagaagatctacagcaac

SEQ ID NO: 29549 - RNA, 21 nt, synthetic construct
  misc_feature 1..21: note = derived and/or modified sequence opt3 from anti-influenza_CDR
  source 1..21: mol_type = other RNA
atctactataactacaatatt

SEQ ID NO: 29550 - RNA, 21 nt, synthetic construct
  misc_feature 1..21: note = derived and/or modified sequence opt3 from anti-influenza_CDR
  source 1..21: mol_type = other RNA
cagagcatctcctctggctac

SEQ ID NO: 29551 - RNA, 21 nt, synthetic construct
  misc_feature 1..21: note = derived and/or modified sequence opt3 from anti-influenza_CDR
  source 1..21: mol_type = other RNA
cagagcgtgtcctcttcatac

SEQ ID NO: 29552 - RNA, 21 nt, synthetic construct
  misc_feature 1..21: note = derived and/or modified sequence opt3 from anti-influenza_CDR
  source 1..21: mol_type = other RNA
cagaccgtgagctcctcttac

SEQ ID NO: 29553 - RNA, 21 nt, synthetic construct
  misc_feature 1..21: note = derived and/or modified sequence opt3 from anti-influenza_CDR
  source 1..21: mol_type = other RNA
agcaacaatgccgtgtggaac

SEQ ID NO: 29554 - RNA, 21 nt, synthetic construct
  misc_feature 1..21: note = derived and/or modified sequence opt3 from anti-influenza_CDR
  source 1..21: mol_type = other RNA
agcaactccgccgtgtggaat

SEQ ID NO: 29555 - RNA, 21 nt, synthetic construct
  misc_feature 1..21: note = derived and/or modified sequence opt3 from anti-influenza_CDR
  source 1..21: mol_type = other RNA
gccgctaccacactgcagagc

SEQ ID NO: 29556 - RNA, 21 nt, synthetic construct
  misc_feature 1..21: note = derived and/or modified sequence opt3 from anti-influenza_CDR
  source 1..21: mol_type = other RNA
agcaacagagccacctggaat

SEQ ID NO: 29557 - RNA, 21 nt, synthetic construct
  misc_feature 1..21: note = derived and/or modified sequence opt3 from anti-influenza_CDR
  source 1..21: mol_type = other RNA
gccaccagcacactgcagtcc

SEQ ID NO: 29558 - RNA, 21 nt, synthetic construct
  misc_feature 1..21: note = derived and/or modified sequence opt3 from anti-influenza_CDR
  source 1..21: mol_type = other RNA
agcaactccgccacctggaat

SEQ ID NO: 29559 - RNA, 21 nt, synthetic construct
  misc_feature 1..21: note = derived and/or modified sequence opt3 from anti-influenza_CDR
  source 1..21: mol_type = other RNA
gccagctccaccctgcagtct

SEQ ID NO: 29560 - RNA, 21 nt, synthetic construct
  misc_feature 1..21: note = derived and/or modified sequence opt3 from anti-influenza_CDR
  source 1..21: mol_type = other RNA
agctacaacgccgtgtggaat

SEQ ID NO: 29561 - RNA, 21 nt, synthetic construct
  misc_feature 1..21: note = derived and/or modified sequence opt3 from anti-influenza_CDR
  source 1..21: mol_type = other RNA
gccgctagctccagactgtct

SEQ ID NO: 29562 - RNA, 21 nt, synthetic construct
  misc_feature 1..21: note = derived and/or modified sequence opt3 from anti-influenza_CDR
  source 1..21: mol_type = other RNA
gccgctagctccagaggctct

SEQ ID NO: 29563 - RNA, 21 nt, synthetic construct
  misc_feature 1..21: note = derived and/or modified sequence opt3 from anti-influenza_CDR
  source 1..21: mol_type = other RNA
atctaccacagcggctccgcc

SEQ ID NO: 29564 - RNA, 21 nt, synthetic construct
  misc_feature 1..21: note = derived and/or modified sequence opt3 from anti-influenza_CDR
  source 1..21: mol_type = other RNA
atctactatagcggcgtgacc

SEQ ID NO: 29565 - RNA, 21 nt, synthetic construct
  misc_feature 1..21: note = derived and/or modified sequence opt3 from anti-influenza_CDR
  source 1..21: mol_type = other RNA
agctcctacctggcctggtat

SEQ ID NO: 29566 - RNA, 21 nt, synthetic construct
  misc_feature 1..21: note = derived and/or modified sequence opt3 from anti-influenza_CDR
  source 1..21: mol_type = other RNA
cagagcctgtcctcttcaagt

SEQ ID NO: 29567 - RNA, 21 nt, synthetic construct
  misc_feature 1..21: note = derived and/or modified sequence opt3 from anti-influenza_CDR
  source 1..21: mol_type = other RNA
cagagcgtgtccatctcttac

SEQ ID NO: 29568 - RNA, 21 nt, synthetic construct
  misc_feature 1..21: note = derived and/or modified sequence opt3 from anti-influenza_CDR
  source 1..21: mol_type = other RNA
gacgtgaccgagagacccagc

SEQ ID NO: 29569 - RNA, 21 nt, synthetic construct
  misc_feature 1..21: note = derived and/or modified sequence opt3 from anti-influenza_CDR
  source 1..21: mol_type = other RNA
gccgctagcaccctgctcgac

SEQ ID NO: 29570 - RNA, 21 nt, synthetic construct
  misc_feature 1..21: note = derived and/or modified sequence opt3 from anti-influenza_CDR
  source 1..21: mol_type = other RNA
gccgctagcaccctgcactcc

SEQ ID NO: 29571 - RNA, 21 nt, synthetic construct
  misc_feature 1..21: note = derived and/or modified sequence opt3 from anti-influenza_CDR
  source 1..21: mol_type = other RNA
ggcgccagctccctgcagggg

SEQ ID NO: 29572 - RNA, 21 nt, synthetic construct
  misc_feature 1..21: note = derived and/or modified sequence opt3 from anti-influenza_CDR
  source 1..21: mol_type = other RNA
accaacggcgtgaatgtcggg

SEQ ID NO: 29573 - RNA, 21 nt, synthetic construct
  misc_feature 1..21: note = derived and/or modified sequence opt3 from anti-influenza_CDR
  source 1..21: mol_type = other RNA
gacgccagcaccagagctaca

SEQ ID NO: 29574 - RNA, 21 nt, synthetic construct
  misc_feature 1..21: note = derived and/or modified sequence opt3 from anti-influenza_CDR
  source 1..21: mol_type = other RNA
agcgagacctactattggtcc

SEQ ID NO: 29575 - RNA, 21 nt, synthetic construct
  misc_feature 1..21: note = derived and/or modified sequence opt3 from anti-influenza_CDR
  source 1..21: mol_type = other RNA
gaggccgtgaacctggaaagc

SEQ ID NO: 29576 - RNA, 21 nt, synthetic construct
  misc_feature 1..21: note = derived and/or modified sequence opt3 from anti-influenza_CDR
  source 1..21: mol_type = other RNA
ggcgccagcaccagagctaca

SEQ ID NO: 29577 - RNA, 21 nt, synthetic construct
  misc_feature 1..21: note = derived and/or modified sequence opt3 from anti-influenza_CDR
  source 1..21: mol_type = other RNA
gtgagcggctactattggtcc

SEQ ID NO: 29578 - RNA, 21 nt, synthetic construct
  misc_feature 1..21: note = derived and/or modified sequence opt3 from anti-influenza_CDR
  source 1..21: mol_type = other RNA
atcaccggcgtgagagtcggg

SEQ ID NO: 29579 - RNA, 21 nt, synthetic construct
  misc_feature 1..21: note = derived and/or modified sequence opt3 from anti-influenza_CDR
  source 1..21: mol_type = other RNA
gacgccagcaacagagctacc

SEQ ID NO: 29580 - RNA, 21 nt, synthetic construct
  misc_feature 1..21: note = derived and/or modified sequence opt3 from anti-influenza_CDR
  source 1..21: mol_type = other RNA
gaggtgaccaactggcccagc

SEQ ID NO: 29581 - RNA, 21 nt, synthetic construct
  misc_feature 1..21: note = derived and/or modified sequence opt3 from anti-influenza_CDR
  source 1..21: mol_type = other RNA
aaggacagcgagagaccctcc

SEQ ID NO: 29582 - RNA, 21 nt, synthetic construct
  misc_feature 1..21: note = derived and/or modified sequence opt3 from anti-influenza_CDR
  source 1..21: mol_type = other RNA
agcggcaactactattggaat

SEQ ID NO: 29583 - RNA, 21 nt, synthetic construct
  misc_feature 1..21: note = derived and/or modified sequence opt3 from anti-influenza_CDR
  source 1..21: mol_type = other RNA
agcaccacaatcagacactcc

SEQ ID NO: 29584 - RNA, 21 nt, synthetic construct
  misc_feature 1..21: note = derived and/or modified sequence opt3 from anti-influenza_CDR
  source 1..21: mol_type = other RNA
gacgatagcggcagaccctcc

SEQ ID NO: 29585 - RNA, 21 nt, synthetic construct
  misc_feature 1..21: note = derived and/or modified sequence opt3 from anti-influenza_CDR
  source 1..21: mol_type = other RNA
agaaacgacctgaggcccagc

SEQ ID NO: 29586 - RNA, 21 nt, synthetic construct
  misc_feature 1..21: note = derived and/or modified sequence opt3 from anti-influenza_CDR
  source 1..21: mol_type = other RNA
agcgtggaccactactggtcc

SEQ ID NO: 29587 - RNA, 21 nt, synthetic construct
  misc_feature 1..21: note = derived and/or modified sequence opt3 from anti-influenza_CDR
  source 1..21: mol_type = other RNA
gccgtgagcatcctgcagtcc

SEQ ID NO: 29588 - RNA, 21 nt, synthetic construct
  misc_feature 1..21: note = derived and/or modified sequence opt3 from anti-influenza_CDR
  source 1..21: mol_type = other RNA
gacgataccgacagacccagc

SEQ ID NO: 29589 - RNA, 21 nt, synthetic construct
  misc_feature 1..21: note = derived and/or modified sequence opt3 from anti-influenza_CDR
  source 1..21: mol_type = other RNA
gagaacaataagagacccagc

SEQ ID NO: 29590 - RNA, 21 nt, synthetic construct
  misc_feature 1..21: note = derived and/or modified sequence opt3 from anti-influenza_CDR
  source 1..21: mol_type = other RNA
gacagctccaacagagccccc

SEQ ID NO: 29591 - RNA, 21 nt, synthetic construct
  misc_feature 1..21: note = derived and/or modified sequence opt3 from anti-influenza_CDR
  source 1..21: mol_type = other RNA
gaggtgaccaagagacccagc

SEQ ID NO: 29592 - RNA, 21 nt, synthetic construct
  misc_feature 1..21: note = derived and/or modified sequence opt3 from anti-influenza_CDR
  source 1..21: mol_type = other RNA
gccaccagcaacacacactcc

SEQ ID NO: 29593 - RNA, 21 nt, synthetic construct
  misc_feature 1..21: note = derived and/or modified sequence opt3 from anti-influenza_CDR
  source 1..21: mol_type = other RNA
gccgctagcaacctggagaat

SEQ ID NO: 29594 - RNA, 21 nt, synthetic construct
  misc_feature 1..21: note = derived and/or modified sequence opt3 from anti-influenza_CDR
  source 1..21: mol_type = other RNA
gccgctagcggcctgcagtcc

SEQ ID NO: 29595 - RNA, 21 nt, synthetic construct
  misc_feature 1..21: note = derived and/or modified sequence opt3 from anti-influenza_CDR
  source 1..21: mol_type = other RNA
ggcttcaccgtgagctccaac

SEQ ID NO: 29596 - RNA, 21 nt, synthetic construct
  misc_feature 1..21: note = derived and/or modified sequence opt3 from anti-influenza_CDR
  source 1..21: mol_type = other RNA
ggcgggggatacagctggaac

SEQ ID NO: 29597 - RNA, 21 nt, synthetic construct
  misc_feature 1..21: note = derived and/or modified sequence opt3 from anti-influenza_CDR
  source 1..21: mol_type = other RNA
ggcgccagcaacctgcagtcc

SEQ ID NO: 29598 - RNA, 21 nt, synthetic construct
  misc_feature 1..21: note = derived and/or modified sequence opt3 from anti-influenza_CDR
  source 1..21: mol_type = other RNA
ggcgccaccaacctgcagagc

SEQ ID NO: 29599 - RNA, 21 nt, synthetic construct
  misc_feature 1..21: note = derived and/or modified sequence opt3 from anti-influenza_CDR
  source 1..21: mol_type = other RNA
ggcgccagcaacctgcactcc

SEQ ID NO: 29600 - RNA, 21 nt, synthetic construct
  misc_feature 1..21: note = derived and/or modified sequence opt3 from anti-influenza_CDR
  source 1..21: mol_type = other RNA
ggcgccagcaccctgcagtcc

SEQ ID NO: 29601 - RNA, 21 nt, synthetic construct
  misc_feature 1..21: note = derived and/or modified sequence opt3 from anti-influenza_CDR
  source 1..21: mol_type = other RNA
gacaacagcgatagaccctcc

SEQ ID NO: 29602 - RNA, 21 nt, synthetic construct
  misc_feature 1..21: note = derived and/or modified sequence opt3 from anti-influenza_CDR
  source 1..21: mol_type = other RNA
ggcgccagctccctgcagtct

SEQ ID NO: 29603 - RNA, 21 nt, synthetic construct
  misc_feature 1..21: note = derived and/or modified sequence opt3 from anti-influenza_CDR
  source 1..21: mol_type = other RNA
ggcaacagcaatagaccctcc

SEQ ID NO: 29604 - RNA, 21 nt, synthetic construct
  misc_feature 1..21: note = derived and/or modified sequence opt3 from anti-influenza_CDR
  source 1..21: mol_type = other RNA
gccgctagctccctgcagtct

SEQ ID NO: 29605 - RNA, 21 nt, synthetic construct
  misc_feature 1..21: note = derived and/or modified sequence opt3 from anti-influenza_CDR
  source 1..21: mol_type = other RNA
gccgctagctccctgcactct

SEQ ID NO: 29606 - RNA, 21 nt, synthetic construct
  misc_feature 1..21: note = derived and/or modified sequence opt3 from anti-influenza_CDR
  source 1..21: mol_type = other RNA
ggcgccagcaccctgcagaac

SEQ ID NO: 29607 - RNA, 21 nt, synthetic construct
  misc_feature 1..21: note = derived and/or modified sequence opt3 from anti-influenza_CDR
  source 1..21: mol_type = other RNA
ggcgccaccgacctgcagagc

SEQ ID NO: 29608 - RNA, 21 nt, synthetic construct
  misc_feature 1..21: note = derived and/or modified sequence opt3 from anti-influenza_CDR
  source 1..21: mol_type = other RNA
agcggcgcctactattggacc

SEQ ID NO: 29609 - RNA, 21 nt, synthetic construct
  misc_feature 1..21: note = derived and/or modified sequence opt3 from anti-influenza_CDR
  source 1..21: mol_type = other RNA
gtgagcgacaactacatcaat

SEQ ID NO: 29610 - RNA, 21 nt, synthetic construct
  misc_feature 1..21: note = derived and/or modified sequence opt3 from anti-influenza_CDR
  source 1..21: mol_type = other RNA
tgggccagcaccagagagtcc

SEQ ID NO: 29611 - RNA, 21 nt, synthetic construct
  misc_feature 1..21: note = derived and/or modified sequence opt3 from anti-influenza_CDR
  source 1..21: mol_type = other RNA
agcaacaatcagagaccctcc

SEQ ID NO: 29612 - RNA, 21 nt, synthetic construct
  misc_feature 1..21: note = derived and/or modified sequence opt3 from anti-influenza_CDR
  source 1..21: mol_type = other RNA
gaggtgagcaacagaccctcc

SEQ ID NO: 29613 - RNA, 21 nt, synthetic construct
  misc_feature 1..21: note = derived and/or modified sequence opt3 from anti-influenza_CDR
  source 1..21: mol_type = other RNA
aagaacacccagagacccagc

SEQ ID NO: 29614 - RNA, 21 nt, synthetic construct
  misc_feature 1..21: note = derived and/or modified sequence opt3 from anti-influenza_CDR
  source 1..21: mol_type = other RNA
gacaacaataagagacccagc

SEQ ID NO: 29615 - RNA, 21 nt, synthetic construct
  misc_feature 1..21: note = derived and/or modified sequence opt3 from anti-influenza_CDR
  source 1..21: mol_type = other RNA
gacgccagcaccctgagatcc

SEQ ID NO: 29616 - RNA, 21 nt, synthetic construct
  misc_feature 1..21: note = derived and/or modified sequence opt3 from anti-influenza_CDR
  source 1..21: mol_type = other RNA
caggacaacagaaggcccagc

SEQ ID NO: 29617 - RNA, 21 nt, synthetic construct
  misc_feature 1..21: note = derived and/or modified sequence opt3 from anti-influenza_CDR
  source 1..21: mol_type = other RNA
gacgtgagcaagagaccctcc

SEQ ID NO: 29618 - RNA, 21 nt, synthetic construct
  misc_feature 1..21: note = derived and/or modified sequence opt3 from anti-influenza_CDR
  source 1..21: mol_type = other RNA
gacgccagctccagagctacc

SEQ ID NO: 29619 - RNA, 21 nt, synthetic construct
  misc_feature 1..21: note = derived and/or modified sequence opt3 from anti-influenza_CDR
  source 1..21: mol_type = other RNA
ctgggcagcaacagagcctcc

SEQ ID NO: 29620 - RNA, 21 nt, synthetic construct
  misc_feature 1..21: note = derived and/or modified sequence opt3 from anti-influenza_CDR
  source 1..21: mol_type = other RNA
ggcgccagcaccagagctgca

SEQ ID NO: 29621 - RNA, 21 nt, synthetic construct
  misc_feature 1..21: note = derived and/or modified sequence opt3 from anti-influenza_CDR
  source 1..21: mol_type = other RNA
gacgatagcgacagaccctcc

SEQ ID NO: 29622 - RNA, 21 nt, synthetic construct
  misc_feature 1..21: note = derived and/or modified sequence opt3 from anti-influenza_CDR
  source 1..21: mol_type = other RNA
agagacggccagaggcccagc

SEQ ID NO: 29623 - RNA, 21 nt, synthetic construct
  misc_feature 1..21: note = derived and/or modified sequence opt3 from anti-influenza_CDR
  source 1..21: mol_type = other RNA
ggcgccagctccagagctacc

SEQ ID NO: 29624 - RNA, 21 nt, synthetic construct
  misc_feature 1..21: note = derived and/or modified sequence opt3 from anti-influenza_CDR
  source 1..21: mol_type = other RNA
ggcgccagctccagagcttct

SEQ ID NO: 29625 - RNA, 21 nt, synthetic construct
  misc_feature 1..21: note = derived and/or modified sequence opt3 from anti-influenza_CDR
  source 1..21: mol_type = other RNA
gccgctagcaccctgcagtcc

SEQ ID NO: 29626 - RNA, 21 nt, synthetic construct
  misc_feature 1..21: note = derived and/or modified sequence opt3 from anti-influenza_CDR
  source 1..21: mol_type = other RNA
ctggtgagcaagagagcctcc

SEQ ID NO: 29627 - RNA, 21 nt, synthetic construct
  misc_feature 1..21: note = derived and/or modified sequence opt3 from anti-influenza_CDR
  source 1..21: mol_type = other RNA
gacgtgacctacagacccagc

SEQ ID NO: 29628 - RNA, 21 nt, synthetic construct
  misc_feature 1..21: note = derived and/or modified sequence opt3 from anti-influenza_CDR
  source 1..21: mol_type = other RNA
atgcaggccctggagaccccc

SEQ ID NO: 29629 - RNA, 21 nt, synthetic construct
  misc_feature 1..21: note = derived and/or modified sequence opt3 from anti-influenza_CDR
  source 1..21: mol_type = other RNA
cagaactacggcagccccttc

SEQ ID NO: 29630 - RNA, 21 nt, synthetic construct
  misc_feature 1..21: note = derived and/or modified sequence opt3 from anti-influenza_CDR
  source 1..21: mol_type = other RNA
cagcaatacggcagcctgccc

SEQ ID NO: 29631 - RNA, 21 nt, synthetic construct
  misc_feature 1..21: note = derived and/or modified sequence opt3 from anti-influenza_CDR
  source 1..21: mol_type = other RNA
tggggcagctacctggagtcc

SEQ ID NO: 29632 - RNA, 21 nt, synthetic construct
  misc_feature 1..21: note = derived and/or modified sequence opt3 from anti-influenza_CDR
  source 1..21: mol_type = other RNA
agcgcctccaccagagctaca

SEQ ID NO: 29633 - RNA, 21 nt, synthetic construct
  misc_feature 1..21: note = derived and/or modified sequence opt3 from anti-influenza_CDR
  source 1..21: mol_type = other RNA
ggcgccagcaccagagcttcc

SEQ ID NO: 29634 - RNA, 21 nt, synthetic construct
  misc_feature 1..21: note = derived and/or modified sequence opt3 from anti-influenza_CDR
  source 1..21: mol_type = other RNA
ggcgccagcaccagagacaca

SEQ ID NO: 29635 - RNA, 21 nt, synthetic construct
  misc_feature 1..21: note = derived and/or modified sequence opt3 from anti-influenza_CDR
  source 1..21: mol_type = other RNA
aaggtgagcaccctggagtcc

SEQ ID NO: 29636 - RNA, 21 nt, synthetic construct
  misc_feature 1..21: note = derived and/or modified sequence opt3 from anti-influenza_CDR
  source 1..21: mol_type = other RNA
agcaacaccgagagaccctcc

SEQ ID NO: 29637 - RNA, 21 nt, synthetic construct
  misc_feature 1..21: note = derived and/or modified sequence opt3 from anti-influenza_CDR
  source 1..21: mol_type = other RNA
aagatcagcaacagagactcc

SEQ ID NO: 29638 - RNA, 21 nt, synthetic construct
  misc_feature 1..21: note = derived and/or modified sequence opt3 from anti-influenza_CDR
  source 1..21: mol_type = other RNA
agcgcctcccacagatactct

SEQ ID NO: 29639 - RNA, 21 nt, synthetic construct
  misc_feature 1..21: note = derived and/or modified sequence opt3 from anti-influenza_CDR
  source 1..21: mol_type = other RNA
cagagcgtgagatccaacaat

SEQ ID NO: 29640 - RNA, 21 nt, synthetic construct
  misc_feature 1..21: note = derived and/or modified sequence opt3 from anti-influenza_CDR
  source 1..21: mol_type = other RNA
cagagcgtgagatccggctac

SEQ ID NO: 29641 - RNA, 21 nt, synthetic construct
  misc_feature 1..21: note = derived and/or modified sequence opt3 from anti-influenza_CDR
  source 1..21: mol_type = other RNA
atctactatagaggcagcacc

SEQ ID NO: 29642 - RNA, 21 nt, synthetic construct
  misc_feature 1..21: note = derived and/or modified sequence opt3 from anti-influenza_CDR
  source 1..21: mol_type = other RNA
gtgtactatagcggcatcacc

SEQ ID NO: 29643 - RNA, 21 nt, synthetic construct
  misc_feature 1..21: note = derived and/or modified sequence opt3 from anti-influenza_CDR
  source 1..21: mol_type = other RNA
agccacttcgccaacctgaag

SEQ ID NO: 29644 - RNA, 21 nt, synthetic construct
  misc_feature 1..21: note = derived and/or modified sequence opt3 from anti-influenza_CDR
  source 1..21: mol_type = other RNA
ctgaacaagagcaaaccctac

SEQ ID NO: 29645 - RNA, 21 nt, synthetic construct
  misc_feature 1..21: note = derived and/or modified sequence opt3 from anti-influenza_CDR
  source 1..21: mol_type = other RNA
aagctggccaacaccggcaca

SEQ ID NO: 29646 - RNA, 21 nt, synthetic construct
  misc_feature 1..21: note = derived and/or modified sequence opt3 from anti-influenza_CDR
  source 1..21: mol_type = other RNA
gccgctagcaccctgacatcc

SEQ ID NO: 29647 - RNA, 21 nt, synthetic construct
  misc_feature 1..21: note = derived and/or modified sequence opt3 from anti-influenza_CDR
  source 1..21: mol_type = other RNA
gacgccagcaagctggcttcc

SEQ ID NO: 29648 - RNA, 21 nt, synthetic construct
  misc_feature 1..21: note = derived and/or modified sequence opt3 from anti-influenza_CDR
  source 1..21: mol_type = other RNA
ttcgccagcagactggcttcc

SEQ ID NO: 29649 - RNA, 21 nt, synthetic construct
  misc_feature 1..21: note = derived and/or modified sequence opt3 from anti-influenza_CDR
  source 1..21: mol_type = other RNA
agcgcctccaccctggcttct

SEQ ID NO: 29650 - RNA, 21 nt, synthetic construct
  misc_feature 1..21: note = derived and/or modified sequence opt3 from anti-influenza_CDR
  source 1..21: mol_type = other RNA
gaggtgagccagagaccctcc

SEQ ID NO: 29651 - RNA, 21 nt, synthetic construct
  misc_feature 1..21: note = derived and/or modified sequence opt3 from anti-influenza_CDR
  source 1..21: mol_type = other RNA
ggcgggaccctgaacaattac

SEQ ID NO: 29652 - RNA, 21 nt, synthetic construct
  misc_feature 1..21: note = derived and/or modified sequence opt3 from anti-influenza_CDR
  source 1..21: mol_type = other RNA
gacatcgtgatgacccagagc

SEQ ID NO: 29653 - RNA, 24 nt, synthetic construct
  misc_feature 1..24: note = derived and/or modified sequence opt3 from anti-influenza_CDR
  source 1..24: mol_type = other RNA
ggcttcacctttagcaactacgcc

SEQ ID NO: 29654 - RNA, 24 nt, synthetic construct
  misc_feature 1..24: note = derived and/or modified sequence opt3 from anti-influenza_CDR
  source 1..24: mol_type = other RNA
ggcttcacctttagcaactacggg

SEQ ID NO: 29655 - RNA, 24 nt, synthetic construct
  misc_feature 1..24: note = derived and/or modified sequence opt3 from anti-influenza_CDR
  source 1..24: mol_type = other RNA
ggcttcacctttagctcctacgcc

SEQ ID NO: 29656 - RNA, 24 nt, synthetic construct
  misc_feature 1..24: note = derived and/or modified sequence opt3 from anti-influenza_CDR
  source 1..24: mol_type = other RNA
ggcttcacctttagcacatacgcc

SEQ ID NO: 29657 - RNA, 24 nt, synthetic construct
  misc_feature 1..24: note = derived and/or modified sequence opt3 from anti-influenza_CDR
  source 1..24: mol_type = other RNA
ggcgggatcttcattagccaggcc

SEQ ID NO: 29658 - RNA, 24 nt, synthetic construct
  misc_feature 1..24: note = derived and/or modified sequence opt3 from anti-influenza_CDR
  source 1..24: mol_type = other RNA
ggcgggatcttcagcccctacgcc

SEQ ID NO: 29659 - RNA, 24 nt, synthetic construct
  misc_feature 1..24: note = derived and/or modified sequence opt3 from anti-influenza_CDR
  source 1..24: mol_type = other RNA
ggcgggcccttcagcggatttgcc

SEQ ID NO: 29660 - RNA, 24 nt, synthetic construct
  misc_feature 1..24: note = derived and/or modified sequence opt3 from anti-influenza_CDR
  source 1..24: mol_type = other RNA
ggcgggaccttcaacagccacgcc

SEQ ID NO: 29661 - RNA, 24 nt, synthetic construct
  misc_feature 1..24: note = derived and/or modified sequence opt3 from anti-influenza_CDR
  source 1..24: mol_type = other RNA
ggcagcaacatcgggtccaatacc

SEQ ID NO: 29662 - RNA, 24 nt, synthetic construct
  misc_feature 1..24: note = derived and/or modified sequence opt3 from anti-influenza_CDR
  source 1..24: mol_type = other RNA
ggcgtgaccttcagcatgtacgcc

SEQ ID NO: 29663 - RNA, 24 nt, synthetic construct
  misc_feature 1..24: note = derived and/or modified sequence opt3 from anti-influenza_CDR
  source 1..24: mol_type = other RNA
ggcgtgaccttcagcatgtacaca

SEQ ID NO: 29664 - RNA, 24 nt, synthetic construct
  misc_feature 1..24: note = derived and/or modified sequence opt3 from anti-influenza_CDR
  source 1..24: mol_type = other RNA
ggcgtgaccagctccaactacccc

SEQ ID NO: 29665 - RNA, 24 nt, synthetic construct
  misc_feature 1..24: note = derived and/or modified sequence opt3 from anti-influenza_CDR
  source 1..24: mol_type = other RNA
atcattgccatattcggcaccaca

SEQ ID NO: 29666 - RNA, 24 nt, synthetic construct
  misc_feature 1..24: note = derived and/or modified sequence opt3 from anti-influenza_CDR
  source 1..24: mol_type = other RNA
atcattcccctgttcggcaccgcc

SEQ ID NO: 29667 - RNA, 24 nt, synthetic construct
  misc_feature 1..24: note = derived and/or modified sequence opt3 from anti-influenza_CDR
  source 1..24: mol_type = other RNA
atcattcccctgttcggcaccaca

SEQ ID NO: 29668 - RNA, 24 nt, synthetic construct
  misc_feature 1..24: note = derived and/or modified sequence opt3 from anti-influenza_CDR
  source 1..24: mol_type = other RNA
atcattcccatgttcggcgccacc

SEQ ID NO: 29669 - RNA, 24 nt, synthetic construct
  misc_feature 1..24: note = derived and/or modified sequence opt3 from anti-influenza_CDR
  source 1..24: mol_type = other RNA
atcattcccatgttcggcaccaca

SEQ ID NO: 29670 - RNA, 24 nt, synthetic construct
  misc_feature 1..24: note = derived and/or modified sequence opt3 from anti-influenza_CDR
  source 1..24: mol_type = other RNA
atcaacagcggcgggggagccacc

SEQ ID NO: 29671 - RNA, 24 nt, synthetic construct
  misc_feature 1..24: note = derived and/or modified sequence opt3 from anti-influenza_CDR
  source 1..24: mol_type = other RNA
atcagcgccgtgttcggcaccgct

SEQ ID NO: 29672 - RNA, 24 nt, synthetic construct
  misc_feature 1..24: note = derived and/or modified sequence opt3 from anti-influenza_CDR
  source 1..24: mol_type = other RNA
atcagctacgacgccaactataag

SEQ ID NO: 29673 - RNA, 24 nt, synthetic construct
  misc_feature 1..24: note = derived and/or modified sequence opt3 from anti-influenza_CDR
  source 1..24: mol_type = other RNA
atcagctacgacggcaactataag

SEQ ID NO: 29674 - RNA, 24 nt, synthetic construct
  misc_feature 1..24: note = derived and/or modified sequence opt3 from anti-influenza_CDR
  source 1..24: mol_type = other RNA
atcagctacgacggctccaacaag

SEQ ID NO: 29675 - RNA, 24 nt, synthetic construct
  misc_feature 1..24: note = derived and/or modified sequence opt3 from anti-influenza_CDR
  source 1..24: mol_type = other RNA
atcagctacgacggctccaaccag

SEQ ID NO: 29676 - RNA, 24 nt, synthetic construct
  misc_feature 1..24: note = derived and/or modified sequence opt3 from anti-influenza_CDR
  source 1..24: mol_type = other RNA
cagcaatactatagaagcccctcc

SEQ ID NO: 29677 - RNA, 24 nt, synthetic construct
  misc_feature 1..24: note = derived and/or modified sequence opt3 from anti-influenza_CDR
  source 1..24: mol_type = other RNA
gtgctgcccctcttcggcgtcacc

SEQ ID NO: 29678 - RNA, 24 nt, synthetic construct
  misc_feature 1..24: note = derived and/or modified sequence opt3 from anti-influenza_CDR
  source 1..24: mol_type = other RNA
ggcgggaccttcagctccgacgcc

SEQ ID NO: 29679 - RNA, 24 nt, synthetic construct
  misc_feature 1..24: note = derived and/or modified sequence opt3 from anti-influenza_CDR
  source 1..24: mol_type = other RNA
atcattcccgtgttccagaccgcc

SEQ ID NO: 29680 - RNA, 24 nt, synthetic construct
  misc_feature 1..24: note = derived and/or modified sequence opt3 from anti-influenza_CDR
  source 1..24: mol_type = other RNA
accagcaacatcggctccaatgcc

SEQ ID NO: 29681 - RNA, 24 nt, synthetic construct
  misc_feature 1..24: note = derived and/or modified sequence opt3 from anti-influenza_CDR
  source 1..24: mol_type = other RNA
ggctacagcttcacctccagatgg

SEQ ID NO: 29682 - RNA, 24 nt, synthetic construct
  misc_feature 1..24: note = derived and/or modified sequence opt3 from anti-influenza_CDR
  source 1..24: mol_type = other RNA
atctaccccagcgactccgatgtg

SEQ ID NO: 29683 - RNA, 24 nt, synthetic construct
  misc_feature 1..24: note = derived and/or modified sequence opt3 from anti-influenza_CDR
  source 1..24: mol_type = other RNA
cagcaatacgacaactggctgagc

SEQ ID NO: 29684 - RNA, 24 nt, synthetic construct
  misc_feature 1..24: note = derived and/or modified sequence opt3 from anti-influenza_CDR
  source 1..24: mol_type = other RNA
ggcgggaccttcagcaactacgga

SEQ ID NO: 29685 - RNA, 24 nt, synthetic construct
  misc_feature 1..24: note = derived and/or modified sequence opt3 from anti-influenza_CDR
  source 1..24: mol_type = other RNA
ggcgccagcatctcctcttcatac

SEQ ID NO: 29686 - RNA, 24 nt, synthetic construct
  misc_feature 1..24: note = derived and/or modified sequence opt3 from anti-influenza_CDR
  source 1..24: mol_type = other RNA
ggcgggaccttcagctcctacgac

SEQ ID NO: 29687 - RNA, 24 nt, synthetic construct
  misc_feature 1..24: note = derived and/or modified sequence opt3 from anti-influenza_CDR
  source 1..24: mol_type = other RNA
atcattcccatatacggcaccgcc

SEQ ID NO: 29688 - RNA, 24 nt, synthetic construct
  misc_feature 1..24: note = derived and/or modified sequence opt3 from anti-influenza_CDR
  source 1..24: mol_type = other RNA
ggctacaccagcacaacttatggg

SEQ ID NO: 29689 - RNA, 24 nt, synthetic construct
  misc_feature 1..24: note = derived and/or modified sequence opt3 from anti-influenza_CDR
  source 1..24: mol_type = other RNA
atcaacccctacaatggcaaccct

SEQ ID NO: 29690 - RNA, 24 nt, synthetic construct
  misc_feature 1..24: note = derived and/or modified sequence opt3 from anti-influenza_CDR
  source 1..24: mol_type = other RNA
atctggtacgacggcgataacaag

SEQ ID NO: 29691 - RNA, 24 nt, synthetic construct
  misc_feature 1..24: note = derived and/or modified sequence opt3 from anti-influenza_CDR
  source 1..24: mol_type = other RNA
ggcttcacctttagcgacttctgg

SEQ ID NO: 29692 - RNA, 24 nt, synthetic construct
  misc_feature 1..24: note = derived and/or modified sequence opt3 from anti-influenza_CDR
  source 1..24: mol_type = other RNA
atcgaccaggatggcaacgagaga

SEQ ID NO: 29693 - RNA, 24 nt, synthetic construct
  misc_feature 1..24: note = derived and/or modified sequence opt3 from anti-influenza_CDR
  source 1..24: mol_type = other RNA
agctccaacatcggcaagaattac

SEQ ID NO: 29694 - RNA, 24 nt, synthetic construct
  misc_feature 1..24: note = derived and/or modified sequence opt3 from anti-influenza_CDR
  source 1..24: mol_type = other RNA
ggctacaccttcacaaactattgg

SEQ ID NO: 29695 - RNA, 24 nt, synthetic construct
  misc_feature 1..24: note = derived and/or modified sequence opt3 from anti-influenza_CDR
  source 1..24: mol_type = other RNA
atcttccctcccgacagccagacc

SEQ ID NO: 29696 - RNA, 24 nt, synthetic construct
  misc_feature 1..24: note = derived and/or modified sequence opt3 from anti-influenza_CDR
  source 1..24: mol_type = other RNA
ggctacagcttctccgactattgg

SEQ ID NO: 29697 - RNA, 24 nt, synthetic construct
  misc_feature 1..24: note = derived and/or modified sequence opt3 from anti-influenza_CDR
  source 1..24: mol_type = other RNA
atctaccccgccagctccgagatt

SEQ ID NO: 29698 - RNA, 24 nt, synthetic construct
  misc_feature 1..24: note = derived and/or modified sequence opt3 from anti-influenza_CDR
  source 1..24: mol_type = other RNA
agcggcgactccgggacctggaac

SEQ ID NO: 29699 - RNA, 24 nt, synthetic construct
  misc_feature 1..24: note = derived and/or modified sequence opt3 from anti-influenza_CDR
  source 1..24: mol_type = other RNA
ggcgggaccctgaacaattacgcc

SEQ ID NO: 29700 - RNA, 24 nt, synthetic construct
  misc_feature 1..24: note = derived and/or modified sequence opt3 from anti-influenza_CDR
  source 1..24: mol_type = other RNA
atcagccccattttcggcaccctg

SEQ ID NO: 29701 - RNA, 24 nt, synthetic construct
  misc_feature 1..24: note = derived and/or modified sequence opt3 from anti-influenza_CDR
  source 1..24: mol_type = other RNA
ggcgtgttctttagctcccacgcc

SEQ ID NO: 29702 - RNA, 24 nt, synthetic construct
  misc_feature 1..24: note = derived and/or modified sequence opt3 from anti-influenza_CDR
  source 1..24: mol_type = other RNA
atcagccccatgttcggcaccaca

SEQ ID NO: 29703 - RNA, 24 nt, synthetic construct
  misc_feature 1..24: note = derived and/or modified sequence opt3 from anti-influenza_CDR
  source 1..24: mol_type = other RNA
ggcttcacctttagcagattcggg

SEQ ID NO: 29704 - RNA, 24 nt, synthetic construct
  misc_feature 1..24: note = derived and/or modified sequence opt3 from anti-influenza_CDR
  source 1..24: mol_type = other RNA
atctggtacgacggcagcaacaag

SEQ ID NO: 29705 - RNA, 24 nt, synthetic construct
  misc_feature 1..24: note = derived and/or modified sequence opt3 from anti-influenza_CDR
  source 1..24: mol_type = other RNA
cagacctacggcggggtgagcaca

SEQ ID NO: 29706 - RNA, 24 nt, synthetic construct
  misc_feature 1..24: note = derived and/or modified sequence opt3 from anti-influenza_CDR
  source 1..24: mol_type = other RNA
gacagcgccggcaacagacactcc

SEQ ID NO: 29707 - RNA, 24 nt, synthetic construct
  misc_feature 1..24: note = derived and/or modified sequence opt3 from anti-influenza_CDR
  source 1..24: mol_type = other RNA
ttcagaggcgggaacagcctgtcc

SEQ ID NO: 29708 - RNA, 24 nt, synthetic construct
  misc_feature 1..24: note = derived and/or modified sequence opt3 from anti-influenza_CDR
  source 1..24: mol_type = other RNA
ggctacaccttcacaacttattgg

SEQ ID NO: 29709 - RNA, 24 nt, synthetic construct
  misc_feature 1..24: note = derived and/or modified sequence opt3 from anti-influenza_CDR
  source 1..24: mol_type = other RNA
atcgacccctacgatagcgagacc

SEQ ID NO: 29710 - RNA, 24 nt, synthetic construct
  misc_feature 1..24: note = derived and/or modified sequence opt3 from anti-influenza_CDR
  source 1..24: mol_type = other RNA
atcagaaagttcctgaactggtac

SEQ ID NO: 29711 - RNA, 24 nt, synthetic construct
  misc_feature 1..24: note = derived and/or modified sequence opt3 from anti-influenza_CDR
  source 1..24: mol_type = other RNA
cagcaatacgacggcctgcccttc

SEQ ID NO: 29712 - RNA, 24 nt, synthetic construct
  misc_feature 1..24: note = derived and/or modified sequence opt3 from anti-influenza_CDR
  source 1..24: mol_type = other RNA
atcagaaacagcctgaattggtac

SEQ ID NO: 29713 - RNA, 24 nt, synthetic construct
  misc_feature 1..24: note = derived and/or modified sequence opt3 from anti-influenza_CDR
  source 1..24: mol_type = other RNA
cagcaagccaacagcttccccctg

SEQ ID NO: 29714 - RNA, 24 nt, synthetic construct
  misc_feature 1..24: note = derived and/or modified sequence opt3 from anti-influenza_CDR
  source 1..24: mol_type = other RNA
agcctgctcaccgaggtggaaaca

SEQ ID NO: 29715 - RNA, 24 nt, synthetic construct
  misc_feature 1..24: note = derived and/or modified sequence opt3 from anti-influenza_CDR
  source 1..24: mol_type = other RNA
cagcaaagctactccatgcccgcc

SEQ ID NO: 29716 - RNA, 24 nt, synthetic construct
  misc_feature 1..24: note = derived and/or modified sequence opt3 from anti-influenza_CDR
  source 1..24: mol_type = other RNA
ggcgggcccgtgagcggaggtggc

SEQ ID NO: 29717 - RNA, 24 nt, synthetic construct
  misc_feature 1..24: note = derived and/or modified sequence opt3 from anti-influenza_CDR
  source 1..24: mol_type = other RNA
caacagagcttctccgtgcccgcc

SEQ ID NO: 29718 - RNA, 24 nt, synthetic construct
  misc_feature 1..24: note = derived and/or modified sequence opt3 from anti-influenza_CDR
  source 1..24: mol_type = other RNA
cagcaaacctacagcatccccctg

SEQ ID NO: 29719 - RNA, 24 nt, synthetic construct
  misc_feature 1..24: note = derived and/or modified sequence opt3 from anti-influenza_CDR
  source 1..24: mol_type = other RNA
cagcaaagctactccgtgcccgcc

SEQ ID NO: 29720 - RNA, 24 nt, synthetic construct
  misc_feature 1..24: note = derived and/or modified sequence opt3 from anti-influenza_CDR
  source 1..24: mol_type = other RNA
cagcaaaccttcagcatccccctg

SEQ ID NO: 29721 - RNA, 24 nt, synthetic construct
  misc_feature 1..24: note = derived and/or modified sequence opt3 from anti-influenza_CDR
  source 1..24: mol_type = other RNA
ggcgacagcatcacctccggggcc

SEQ ID NO: 29722 - RNA, 24 nt, synthetic construct
  misc_feature 1..24: note = derived and/or modified sequence opt3 from anti-influenza_CDR
  source 1..24: mol_type = other RNA
caggcctgggacagctccaccgct

SEQ ID NO: 29723 - RNA, 24 nt, synthetic construct
  misc_feature 1..24: note = derived and/or modified sequence opt3 from anti-influenza_CDR
  source 1..24: mol_type = other RNA
cagcaatacggcagctccctgtgg

SEQ ID NO: 29724 - RNA, 24 nt, synthetic construct
  misc_feature 1..24: note = derived and/or modified sequence opt3 from anti-influenza_CDR
  source 1..24: mol_type = other RNA
gcctacggctataccttcgacccc

SEQ ID NO: 29725 - RNA, 24 nt, synthetic construct
  misc_feature 1..24: note = derived and/or modified sequence opt3 from anti-influenza_CDR
  source 1..24: mol_type = other RNA
atgcaggccctgcaaacccccctc

SEQ ID NO: 29726 - RNA, 24 nt, synthetic construct
  misc_feature 1..24: note = derived and/or modified sequence opt3 from anti-influenza_CDR
  source 1..24: mol_type = other RNA
cagcaatacggcagctccctgacc

SEQ ID NO: 29727 - RNA, 24 nt, synthetic construct
  misc_feature 1..24: note = derived and/or modified sequence opt3 from anti-influenza_CDR
  source 1..24: mol_type = other RNA
cagaagtacaacagcgccccctcc

SEQ ID NO: 29728 - RNA, 24 nt, synthetic construct
  misc_feature 1..24: note = derived and/or modified sequence opt3 from anti-influenza_CDR
  source 1..24: mol_type = other RNA
cagcaaagaagcaactggctgaag

SEQ ID NO: 29729 - RNA, 24 nt, synthetic construct
  misc_feature 1..24: note = derived and/or modified sequence opt3 from anti-influenza_CDR
  source 1..24: mol_type = other RNA
agctcccagtctagatcaagtacc

SEQ ID NO: 29730 - RNA, 24 nt, synthetic construct
  misc_feature 1..24: note = derived and/or modified sequence opt3 from anti-influenza_CDR
  source 1..24: mol_type = other RNA
ccctacgacgtgcctgattatgag

SEQ ID NO: 29731 - RNA, 24 nt, synthetic construct
  misc_feature 1..24: note = derived and/or modified sequence opt3 from anti-influenza_CDR
  source 1..24: mol_type = other RNA
ccctacgacgtgcctgattatgcc

SEQ ID NO: 29732 - RNA, 24 nt, synthetic construct
  misc_feature 1..24: note = derived and/or modified sequence opt3 from anti-influenza_CDR
  source 1..24: mol_type = other RNA
cccggcgacttcaacgattacgag

SEQ ID NO: 29733 - RNA, 24 nt, synthetic construct
  misc_feature 1..24: note = derived and/or modified sequence opt3 from anti-influenza_CDR
  source 1..24: mol_type = other RNA
cccaaggtgagagaccaggagagc

SEQ ID NO: 29734 - RNA, 24 nt, synthetic construct
  misc_feature 1..24: note = derived and/or modified sequence opt3 from anti-influenza_CDR
  source 1..24: mol_type = other RNA
accagctacacatcctctaacact

SEQ ID NO: 29735 - RNA, 24 nt, synthetic construct
  misc_feature 1..24: note = derived and/or modified sequence opt3 from anti-influenza_CDR
  source 1..24: mol_type = other RNA
ggcgggaacttcaataactacgcc

SEQ ID NO: 29736 - RNA, 24 nt, synthetic construct
  misc_feature 1..24: note = derived and/or modified sequence opt3 from anti-influenza_CDR
  source 1..24: mol_type = other RNA
atcagccccattttcggctccacc

SEQ ID NO: 29737 - RNA, 24 nt, synthetic construct
  misc_feature 1..24: note = derived and/or modified sequence opt3 from anti-influenza_CDR
  source 1..24: mol_type = other RNA
agctcctacacctcttcaaacaca

SEQ ID NO: 29738 - RNA, 24 nt, synthetic construct
  misc_feature 1..24: note = derived and/or modified sequence opt3 from anti-influenza_CDR
  source 1..24: mol_type = other RNA
ggcgggaccttcaacaattacgcc

SEQ ID NO: 29739 - RNA, 24 nt, synthetic construct
  misc_feature 1..24: note = derived and/or modified sequence opt3 from anti-influenza_CDR
  source 1..24: mol_type = other RNA
atcagccccattttcggctccgtg

SEQ ID NO: 29740 - RNA, 24 nt, synthetic construct
  misc_feature 1..24: note = derived and/or modified sequence opt3 from anti-influenza_CDR
  source 1..24: mol_type = other RNA
agctccaacatcggccacaatttc

SEQ ID NO: 29741 - RNA, 24 nt, synthetic construct
  misc_feature 1..24: note = derived and/or modified sequence opt3 from anti-influenza_CDR
  source 1..24: mol_type = other RNA
ggcacctgggacagctccctgtct

SEQ ID NO: 29742 - RNA, 24 nt, synthetic construct
  misc_feature 1..24: note = derived and/or modified sequence opt3 from anti-influenza_CDR
  source 1..24: mol_type = other RNA
ggcgggatcattagaaagtacgcc

SEQ ID NO: 29743 - RNA, 24 nt, synthetic construct
  misc_feature 1..24: note = derived and/or modified sequence opt3 from anti-influenza_CDR
  source 1..24: mol_type = other RNA
atcattgccatattcaacaccgct

SEQ ID NO: 29744 - RNA, 24 nt, synthetic construct
  misc_feature 1..24: note = derived and/or modified sequence opt3 from anti-influenza_CDR
  source 1..24: mol_type = other RNA
ggctacaccttcacagcctatact

SEQ ID NO: 29745 - RNA, 24 nt, synthetic construct
  misc_feature 1..24: note = derived and/or modified sequence opt3 from anti-influenza_CDR
  source 1..24: mol_type = other RNA
atcaacgccggcaatgggcacacc

SEQ ID NO: 29746 - RNA, 24 nt, synthetic construct
  misc_feature 1..24: note = derived and/or modified sequence opt3 from anti-influenza_CDR
  source 1..24: mol_type = other RNA
ggcgggaccttcatcaactacgcc

SEQ ID NO: 29747 - RNA, 24 nt, synthetic construct
  misc_feature 1..24: note = derived and/or modified sequence opt3 from anti-influenza_CDR
  source 1..24: mol_type = other RNA
atcattcccgtgtacggcaccagc

SEQ ID NO: 29748 - RNA, 24 nt, synthetic construct
  misc_feature 1..24: note = derived and/or modified sequence opt3 from anti-influenza_CDR
  source 1..24: mol_type = other RNA
ggcttcacctttagaagccacgcc

SEQ ID NO: 29749 - RNA, 24 nt, synthetic construct
  misc_feature 1..24: note = derived and/or modified sequence opt3 from anti-influenza_CDR
  source 1..24: mol_type = other RNA
atcagctacgacgaggtgaacaag

SEQ ID NO: 29750 - RNA, 24 nt, synthetic construct
  misc_feature 1..24: note = derived and/or modified sequence opt3 from anti-influenza_CDR
  source 1..24: mol_type = other RNA
ggctacaacttcgccgcttattac

SEQ ID NO: 29751 - RNA, 24 nt, synthetic construct
  misc_feature 1..24: note = derived and/or modified sequence opt3 from anti-influenza_CDR
  source 1..24: mol_type = other RNA
agcaaccccaataccggcggggcc

SEQ ID NO: 29752 - RNA, 24 nt, synthetic construct
  misc_feature 1..24: note = derived and/or modified sequence opt3 from anti-influenza_CDR
  source 1..24: mol_type = other RNA
ggctacaccctgatcgactattac

SEQ ID NO: 29753 - RNA, 24 nt, synthetic construct
  misc_feature 1..24: note = derived and/or modified sequence opt3 from anti-influenza_CDR
  source 1..24: mol_type = other RNA
atcaaccccattaatggcgggacc

SEQ ID NO: 29754 - RNA, 24 nt, synthetic construct
  misc_feature 1..24: note = derived and/or modified sequence opt3 from anti-influenza_CDR
  source 1..24: mol_type = other RNA
ggcttcacctttagcgcctacgct

SEQ ID NO: 29755 - RNA, 24 nt, synthetic construct
  misc_feature 1..24: note = derived and/or modified sequence opt3 from anti-influenza_CDR
  source 1..24: mol_type = other RNA
accagctacgacggcagagattcc

SEQ ID NO: 29756 - RNA, 24 nt, synthetic construct
  misc_feature 1..24: note = derived and/or modified sequence opt3 from anti-influenza_CDR
  source 1..24: mol_type = other RNA
ggcttcacctttacaaactacgcc

SEQ ID NO: 29757 - RNA, 24 nt, synthetic construct
  misc_feature 1..24: note = derived and/or modified sequence opt3 from anti-influenza_CDR
  source 1..24: mol_type = other RNA
atcagcttcgacgaggataacaag

SEQ ID NO: 29758 - RNA, 24 nt, synthetic construct
  misc_feature 1..24: note = derived and/or modified sequence opt3 from anti-influenza_CDR
  source 1..24: mol_type = other RNA
ggcttcaactttagctcctacggg

SEQ ID NO: 29759 - RNA, 24 nt, synthetic construct
  misc_feature 1..24: note = derived and/or modified sequence opt3 from anti-influenza_CDR
  source 1..24: mol_type = other RNA
atctggagcggcgggtccaacaag

SEQ ID NO: 29760 - RNA, 24 nt, synthetic construct
  misc_feature 1..24: note = derived and/or modified sequence opt3 from anti-influenza_CDR
  source 1..24: mol_type = other RNA
ggcttcatctttggggacttcgcc

SEQ ID NO: 29761 - RNA, 24 nt, synthetic construct
  misc_feature 1..24: note = derived and/or modified sequence opt3 from anti-influenza_CDR
  source 1..24: mol_type = other RNA
ggcttcaactttgacgagtacgtg

SEQ ID NO: 29762 - RNA, 24 nt, synthetic construct
  misc_feature 1..24: note = derived and/or modified sequence opt3 from anti-influenza_CDR
  source 1..24: mol_type = other RNA
atcggcgccgacgggagaggaacc

SEQ ID NO: 29763 - RNA, 24 nt, synthetic construct
  misc_feature 1..24: note = derived and/or modified sequence opt3 from anti-influenza_CDR
  source 1..24: mol_type = other RNA
ggcgggagcgtgtccaactactat

SEQ ID NO: 29764 - RNA, 24 nt, synthetic construct
  misc_feature 1..24: note = derived and/or modified sequence opt3 from anti-influenza_CDR
  source 1..24: mol_type = other RNA
ggcgggaccttcagctactatgcc

SEQ ID NO: 29765 - RNA, 24 nt, synthetic construct
  misc_feature 1..24: note = derived and/or modified sequence opt3 from anti-influenza_CDR
  source 1..24: mol_type = other RNA
atcattcccatagtgggcaccgcc

SEQ ID NO: 29766 - RNA, 24 nt, synthetic construct
  misc_feature 1..24: note = derived and/or modified sequence opt3 from anti-influenza_CDR
  source 1..24: mol_type = other RNA
accagcaacatcggctccaataca

SEQ ID NO: 29767 - RNA, 24 nt, synthetic construct
  misc_feature 1..24: note = derived and/or modified sequence opt3 from anti-influenza_CDR
  source 1..24: mol_type = other RNA
ggctacaacttccccaagtattgg

SEQ ID NO: 29768 - RNA, 24 nt, synthetic construct
  misc_feature 1..24: note = derived and/or modified sequence opt3 from anti-influenza_CDR
  source 1..24: mol_type = other RNA
atctaccccggcgacagcgatgtg

SEQ ID NO: 29769 - RNA, 24 nt, synthetic construct
  misc_feature 1..24: note = derived and/or modified sequence opt3 from anti-influenza_CDR
  source 1..24: mol_type = other RNA
ggccacaccttcatcagctacgcc

SEQ ID NO: 29770 - RNA, 24 nt, synthetic construct
  misc_feature 1..24: note = derived and/or modified sequence opt3 from anti-influenza_CDR
  source 1..24: mol_type = other RNA
atcgtgcccattttcggcaccgtc

SEQ ID NO: 29771 - RNA, 24 nt, synthetic construct
  misc_feature 1..24: note = derived and/or modified sequence opt3 from anti-influenza_CDR
  source 1..24: mol_type = other RNA
ggcttcacctttagaacatacggg

SEQ ID NO: 29772 - RNA, 24 nt, synthetic construct
  misc_feature 1..24: note = derived and/or modified sequence opt3 from anti-influenza_CDR
  source 1..24: mol_type = other RNA
atcagctacgacggcaccaacaag

SEQ ID NO: 29773 - RNA, 24 nt, synthetic construct
  misc_feature 1..24: note = derived and/or modified sequence opt3 from anti-influenza_CDR
  source 1..24: mol_type = other RNA
ggcttcacctttagctcctacggg

SEQ ID NO: 29774 - RNA, 24 nt, synthetic construct
  misc_feature 1..24: note = derived and/or modified sequence opt3 from anti-influenza_CDR
  source 1..24: mol_type = other RNA
atcagctacgacgagattaacaag

SEQ ID NO: 29775 - RNA, 24 nt, synthetic construct
  misc_feature 1..24: note = derived and/or modified sequence opt3 from anti-influenza_CDR
  source 1..24: mol_type = other RNA
ggcttcagcctgtggacctccggg

SEQ ID NO: 29776 - RNA, 24 nt, synthetic construct
  misc_feature 1..24: note = derived and/or modified sequence opt3 from anti-influenza_CDR
  source 1..24: mol_type = other RNA
atgagctacgacgagaccaagaaa

SEQ ID NO: 29777 - RNA, 24 nt, synthetic construct
  misc_feature 1..24: note = derived and/or modified sequence opt3 from anti-influenza_CDR
  source 1..24: mol_type = other RNA
ggcttcacctttagcagatactcc

SEQ ID NO: 29778 - RNA, 24 nt, synthetic construct
  misc_feature 1..24: note = derived and/or modified sequence opt3 from anti-influenza_CDR
  source 1..24: mol_type = other RNA
atcagcgacacctccagaacaatt

SEQ ID NO: 29779 - RNA, 24 nt, synthetic construct
  misc_feature 1..24: note = derived and/or modified sequence opt3 from anti-influenza_CDR
  source 1..24: mol_type = other RNA
ggcttcacctttaacagctacgcc

SEQ ID NO: 29780 - RNA, 24 nt, synthetic construct
  misc_feature 1..24: note = derived and/or modified sequence opt3 from anti-influenza_CDR
  source 1..24: mol_type = other RNA
atcagaggcagcggggagaacacc

SEQ ID NO: 29781 - RNA, 24 nt, synthetic construct
  misc_feature 1..24: note = derived and/or modified sequence opt3 from anti-influenza_CDR
  source 1..24: mol_type = other RNA
ggcttcacctttagcagattctcc

SEQ ID NO: 29782 - RNA, 24 nt, synthetic construct
  misc_feature 1..24: note = derived and/or modified sequence opt3 from anti-influenza_CDR
  source 1..24: mol_type = other RNA
atcagcgacaccggcagaacaatt

SEQ ID NO: 29783 - RNA, 24 nt, synthetic construct
  misc_feature 1..24: note = derived and/or modified sequence opt3 from anti-influenza_CDR
  source 1..24: mol_type = other RNA
ggcgacagcttcacctcctactgg

SEQ ID NO: 29784 - RNA, 24 nt, synthetic construct
  misc_feature 1..24: note = derived and/or modified sequence opt3 from anti-influenza_CDR
  source 1..24: mol_type = other RNA
atctaccccagagacagcgagacc

SEQ ID NO: 29785 - RNA, 24 nt, synthetic construct
  misc_feature 1..24: note = derived and/or modified sequence opt3 from anti-influenza_CDR
  source 1..24: mol_type = other RNA
ggctacaccttcacagcctatcac

SEQ ID NO: 29786 - RNA, 24 nt, synthetic construct
  misc_feature 1..24: note = derived and/or modified sequence opt3 from anti-influenza_CDR
  source 1..24: mol_type = other RNA
atcaaccccaatagcggcgccacc

SEQ ID NO: 29787 - RNA, 24 nt, synthetic construct
  misc_feature 1..24: note = derived and/or modified sequence opt3 from anti-influenza_CDR
  source 1..24: mol_type = other RNA
ggcttcacctttagcgactactgg

SEQ ID NO: 29788 - RNA, 24 nt, synthetic construct
  misc_feature 1..24: note = derived and/or modified sequence opt3 from anti-influenza_CDR
  source 1..24: mol_type = other RNA
atcagctccgacggctctaccaca

SEQ ID NO: 29789 - RNA, 24 nt, synthetic construct
  misc_feature 1..24: note = derived and/or modified sequence opt3 from anti-influenza_CDR
  source 1..24: mol_type = other RNA
ggcttcagcttttccaacgcctgg

SEQ ID NO: 29790 - RNA, 24 nt, synthetic construct
  misc_feature 1..24: note = derived and/or modified sequence opt3 from anti-influenza_CDR
  source 1..24: mol_type = other RNA
ggcctgaccttcagcaacgcctgg

SEQ ID NO: 29791 - RNA, 24 nt, synthetic construct
  misc_feature 1..24: note = derived and/or modified sequence opt3 from anti-influenza_CDR
  source 1..24: mol_type = other RNA
ggcttcacctttagcaacgcctgg

SEQ ID NO: 29792 - RNA, 24 nt, synthetic construct
  misc_feature 1..24: note = derived and/or modified sequence opt3 from anti-influenza_CDR
  source 1..24: mol_type = other RNA
ggcctgagcttcctcaacgcctgg

SEQ ID NO: 29793 - RNA, 24 nt, synthetic construct
  misc_feature 1..24: note = derived and/or modified sequence opt3 from anti-influenza_CDR
  source 1..24: mol_type = other RNA
ggcttcagctttctgaacgcctgg

SEQ ID NO: 29794 - RNA, 24 nt, synthetic construct
  misc_feature 1..24: note = derived and/or modified sequence opt3 from anti-influenza_CDR
  source 1..24: mol_type = other RNA
ggcctgaccttcctcaacgcctgg

SEQ ID NO: 29795 - RNA, 24 nt, synthetic construct
  misc_feature 1..24: note = derived and/or modified sequence opt3 from anti-influenza_CDR
  source 1..24: mol_type = other RNA
ggcttcacctttctgaacgcctgg

SEQ ID NO: 29796 - RNA, 24 nt, synthetic construct
  misc_feature 1..24: note = derived and/or modified sequence opt3 from anti-influenza_CDR
  source 1..24: mol_type = other RNA
ggctacaccttcacagactattac

SEQ ID NO: 29797 - RNA, 24 nt, synthetic construct
  misc_feature 1..24: note = derived and/or modified sequence opt3 from anti-influenza_CDR
  source 1..24: mol_type = other RNA
gtgaacccctacagcggcgggacc

SEQ ID NO: 29798 - RNA, 24 nt, synthetic construct
  misc_feature 1..24: note = derived and/or modified sequence opt3 from anti-influenza_CDR
  source 1..24: mol_type = other RNA
ggctacaccttcacagactataac

SEQ ID NO: 29799 - RNA, 24 nt, synthetic construct
  misc_feature 1..24: note = derived and/or modified sequence opt3 from anti-influenza_CDR
  source 1..24: mol_type = other RNA
atctaccccaacaatggcgggacc

SEQ ID NO: 29800 - RNA, 24 nt, synthetic construct
  misc_feature 1..24: note = derived and/or modified sequence opt3 from anti-influenza_CDR
  source 1..24: mol_type = other RNA
ggctacaccttcacagggtataac

SEQ ID NO: 29801 - RNA, 24 nt, synthetic construct
  misc_feature 1..24: note = derived and/or modified sequence opt3 from anti-influenza_CDR
  source 1..24: mol_type = other RNA
atctaccccaacaatggcgtgacc

SEQ ID NO: 29802 - RNA, 24 nt, synthetic construct
  misc_feature 1..24: note = derived and/or modified sequence opt3 from anti-influenza_CDR
  source 1..24: mol_type = other RNA
atggagaccgacacactgctcctt

SEQ ID NO: 29803 - RNA, 27 nt, synthetic construct
  misc_feature 1..27: note = derived and/or modified sequence opt3 from anti-influenza_CDR
  source 1..27: mol_type = other RNA
gacggcgtgaccaacaaggtcaatagc

SEQ ID NO: 29804 - RNA, 27 nt, synthetic construct
  misc_feature 1..27: note = derived and/or modified sequence opt3 from anti-influenza_CDR
  source 1..27: mol_type = other RNA
ggcagcgacgtggggtcctctaacctg

SEQ ID NO: 29805 - RNA, 27 nt, synthetic construct
  misc_feature 1..27: note = derived and/or modified sequence opt3 from anti-influenza_CDR
  source 1..27: mol_type = other RNA
atgcagaacatcctgctcccccttacc

SEQ ID NO: 29806 - RNA, 27 nt, synthetic construct
  misc_feature 1..27: note = derived and/or modified sequence opt3 from anti-influenza_CDR
  source 1..27: mol_type = other RNA
atgcagagcctgcaactcccccttacc

SEQ ID NO: 29807 - RNA, 27 nt, synthetic construct
  misc_feature 1..27: note = derived and/or modified sequence opt3 from anti-influenza_CDR
  source 1..27: mol_type = other RNA
cagcaacactacagaacaccccctacc

SEQ ID NO: 29808 - RNA, 27 nt, synthetic construct
  misc_feature 1..27: note = derived and/or modified sequence opt3 from anti-influenza_CDR
  source 1..27: mol_type = other RNA
cagcaatacggcaacagcccctatacc

SEQ ID NO: 29809 - RNA, 27 nt, synthetic construct
  misc_feature 1..27: note = derived and/or modified sequence opt3 from anti-influenza_CDR
  source 1..27: mol_type = other RNA
cagcaatacggcagctccccctatacc

SEQ ID NO: 29810 - RNA, 27 nt, synthetic construct
  misc_feature 1..27: note = derived and/or modified sequence opt3 from anti-influenza_CDR
  source 1..27: mol_type = other RNA
cagcaatacggcaccagcccccagaca

SEQ ID NO: 29811 - RNA, 27 nt, synthetic construct
  misc_feature 1..27: note = derived and/or modified sequence opt3 from anti-influenza_CDR
  source 1..27: mol_type = other RNA
cagcaatacggctatctgcccctcacc

SEQ ID NO: 29812 - RNA, 27 nt, synthetic construct
  misc_feature 1..27: note = derived and/or modified sequence opt3 from anti-influenza_CDR
  source 1..27: mol_type = other RNA
caggcctgggacagctccaccgctgtg

SEQ ID NO: 29813 - RNA, 27 nt, synthetic construct
  misc_feature 1..27: note = derived and/or modified sequence opt3 from anti-influenza_CDR
  source 1..27: mol_type = other RNA
cagcactacaacgcctattggggcacc

SEQ ID NO: 29814 - RNA, 27 nt, synthetic construct
  misc_feature 1..27: note = derived and/or modified sequence opt3 from anti-influenza_CDR
  source 1..27: mol_type = other RNA
cagcaaacctacagctcccctcccaca

SEQ ID NO: 29815 - RNA, 27 nt, synthetic construct
  misc_feature 1..27: note = derived and/or modified sequence opt3 from anti-influenza_CDR
  source 1..27: mol_type = other RNA
cagcaatactatagcttcccctacacc

SEQ ID NO: 29816 - RNA, 27 nt, synthetic construct
  misc_feature 1..27: note = derived and/or modified sequence opt3 from anti-influenza_CDR
  source 1..27: mol_type = other RNA
atgcaggccctgcaactcccccttgct

SEQ ID NO: 29817 - RNA, 27 nt, synthetic construct
  misc_feature 1..27: note = derived and/or modified sequence opt3 from anti-influenza_CDR
  source 1..27: mol_type = other RNA
cagcaagccaacagcttcccctttacc

SEQ ID NO: 29818 - RNA, 27 nt, synthetic construct
  misc_feature 1..27: note = derived and/or modified sequence opt3 from anti-influenza_CDR
  source 1..27: mol_type = other RNA
cagcaactgaacggctaccccctcacc

SEQ ID NO: 29819 - RNA, 27 nt, synthetic construct
  misc_feature 1..27: note = derived and/or modified sequence opt3 from anti-influenza_CDR
  source 1..27: mol_type = other RNA
atgcaggccctgcaaacacccctcacc

SEQ ID NO: 29820 - RNA, 27 nt, synthetic construct
  misc_feature 1..27: note = derived and/or modified sequence opt3 from anti-influenza_CDR
  source 1..27: mol_type = other RNA
cagcaaaactacaattggcccctgacc

SEQ ID NO: 29821 - RNA, 27 nt, synthetic construct
  misc_feature 1..27: note = derived and/or modified sequence opt3 from anti-influenza_CDR
  source 1..27: mol_type = other RNA
cagcaatacgacaccagctccggcctg

SEQ ID NO: 29822 - RNA, 27 nt, synthetic construct
  misc_feature 1..27: note = derived and/or modified sequence opt3 from anti-influenza_CDR
  source 1..27: mol_type = other RNA
cagcaatacaacagctggcccagaacc

SEQ ID NO: 29823 - RNA, 27 nt, synthetic construct
  misc_feature 1..27: note = derived and/or modified sequence opt3 from anti-influenza_CDR
  source 1..27: mol_type = other RNA
gtgatctacagccacggcagagcctat

SEQ ID NO: 29824 - RNA, 27 nt, synthetic construct
  misc_feature 1..27: note = derived and/or modified sequence opt3 from anti-influenza_CDR
  source 1..27: mol_type = other RNA
cagcaatacggcgacagcagatatacc

SEQ ID NO: 29825 - RNA, 27 nt, synthetic construct
  misc_feature 1..27: note = derived and/or modified sequence opt3 from anti-influenza_CDR
  source 1..27: mol_type = other RNA
ctgcagcacaacagctacccctatacc

SEQ ID NO: 29826 - RNA, 27 nt, synthetic construct
  misc_feature 1..27: note = derived and/or modified sequence opt3 from anti-influenza_CDR
  source 1..27: mol_type = other RNA
agaaagatgaccacagccttcgacagc

SEQ ID NO: 29827 - RNA, 27 nt, synthetic construct
  misc_feature 1..27: note = derived and/or modified sequence opt3 from anti-influenza_CDR
  source 1..27: mol_type = other RNA
cagagaaaccacagcccctcctggacc

SEQ ID NO: 29828 - RNA, 27 nt, synthetic construct
  misc_feature 1..27: note = derived and/or modified sequence opt3 from anti-influenza_CDR
  source 1..27: mol_type = other RNA
cagcaaagctacgacaacccccagacc

SEQ ID NO: 29829 - RNA, 27 nt, synthetic construct
  misc_feature 1..27: note = derived and/or modified sequence opt3 from anti-influenza_CDR
  source 1..27: mol_type = other RNA
cagcaaagcagaaggctgccctacacc

SEQ ID NO: 29830 - RNA, 27 nt, synthetic construct
  misc_feature 1..27: note = derived and/or modified sequence opt3 from anti-influenza_CDR
  source 1..27: mol_type = other RNA
agaaagatgaccacagccatcgactac

SEQ ID NO: 29831 - RNA, 27 nt, synthetic construct
  misc_feature 1..27: note = derived and/or modified sequence opt3 from anti-influenza_CDR
  source 1..27: mol_type = other RNA
atcagatacaccggccagcaactgctc

SEQ ID NO: 29832 - RNA, 27 nt, synthetic construct
  misc_feature 1..27: note = derived and/or modified sequence opt3 from anti-influenza_CDR
  source 1..27: mol_type = other RNA
cagcactacggcaccatcagccaaaca

SEQ ID NO: 29833 - RNA, 27 nt, synthetic construct
  misc_feature 1..27: note = derived and/or modified sequence opt3 from anti-influenza_CDR
  source 1..27: mol_type = other RNA
cagcaatacagcacctcccctcccaca

SEQ ID NO: 29834 - RNA, 27 nt, synthetic construct
  misc_feature 1..27: note = derived and/or modified sequence opt3 from anti-influenza_CDR
  source 1..27: mol_type = other RNA
cagcaatacggcaacagccccatcacc

SEQ ID NO: 29835 - RNA, 27 nt, synthetic construct
  misc_feature 1..27: note = derived and/or modified sequence opt3 from anti-influenza_CDR
  source 1..27: mol_type = other RNA
cagcaatactatagcagaccctacacc

SEQ ID NO: 29836 - RNA, 27 nt, synthetic construct
  misc_feature 1..27: note = derived and/or modified sequence opt3 from anti-influenza_CDR
  source 1..27: mol_type = other RNA
caggtgtgggacaacttcggcggggtc

SEQ ID NO: 29837 - RNA, 27 nt, synthetic construct
  misc_feature 1..27: note = derived and/or modified sequence opt3 from anti-influenza_CDR
  source 1..27: mol_type = other RNA
cagcaaagctactcctctcccctgacc

SEQ ID NO: 29838 - RNA, 27 nt, synthetic construct
  misc_feature 1..27: note = derived and/or modified sequence opt3 from anti-influenza_CDR
  source 1..27: mol_type = other RNA
cagcaatacttcgccacccccagaaca

SEQ ID NO: 29839 - RNA, 27 nt, synthetic construct
  misc_feature 1..27: note = derived and/or modified sequence opt3 from anti-influenza_CDR
  source 1..27: mol_type = other RNA
cagcaatactatttcagccccctgacc

SEQ ID NO: 29840 - RNA, 27 nt, synthetic construct
  misc_feature 1..27: note = derived and/or modified sequence opt3 from anti-influenza_CDR
  source 1..27: mol_type = other RNA
cagcacttcggcaccagcgtgtttaca

SEQ ID NO: 29841 - RNA, 27 nt, synthetic construct
  misc_feature 1..27: note = derived and/or modified sequence opt3 from anti-influenza_CDR
  source 1..27: mol_type = other RNA
cagcaatactataacgcccccctgacc

SEQ ID NO: 29842 - RNA, 27 nt, synthetic construct
  misc_feature 1..27: note = derived and/or modified sequence opt3 from anti-influenza_CDR
  source 1..27: mol_type = other RNA
gtgctgttcaccagcccctttgacttc

SEQ ID NO: 29843 - RNA, 27 nt, synthetic construct
  misc_feature 1..27: note = derived and/or modified sequence opt3 from anti-influenza_CDR
  source 1..27: mol_type = other RNA
ctgctcagctactccggcgtgtgggtc

SEQ ID NO: 29844 - RNA, 27 nt, synthetic construct
  misc_feature 1..27: note = derived and/or modified sequence opt3 from anti-influenza_CDR
  source 1..27: mol_type = other RNA
ttcctgagctactccggcgcctgggtg

SEQ ID NO: 29845 - RNA, 27 nt, synthetic construct
  misc_feature 1..27: note = derived and/or modified sequence opt3 from anti-influenza_CDR
  source 1..27: mol_type = other RNA
caacagagcttctccaagtcttggacc

SEQ ID NO: 29846 - RNA, 27 nt, synthetic construct
  misc_feature 1..27: note = derived and/or modified sequence opt3 from anti-influenza_CDR
  source 1..27: mol_type = other RNA
gtgcagtacgtccaattcccctggacc

SEQ ID NO: 29847 - RNA, 27 nt, synthetic construct
  misc_feature 1..27: note = derived and/or modified sequence opt3 from anti-influenza_CDR
  source 1..27: mol_type = other RNA
cagcaaagctactcccctcccctgacc

SEQ ID NO: 29848 - RNA, 27 nt, synthetic construct
  misc_feature 1..27: note = derived and/or modified sequence opt3 from anti-influenza_CDR
  source 1..27: mol_type = other RNA
ttcatctactatggcgggaacaccaag

SEQ ID NO: 29849 - RNA, 27 nt, synthetic construct
  misc_feature 1..27: note = derived and/or modified sequence opt3 from anti-influenza_CDR
  source 1..27: mol_type = other RNA
gtgatctacagcggcgggtccacctat

SEQ ID NO: 29850 - RNA, 27 nt, synthetic construct
  misc_feature 1..27: note = derived and/or modified sequence opt3 from anti-influenza_CDR
  source 1..27: mol_type = other RNA
ttcatgtttcacagcggctcccccaga

SEQ ID NO: 29851 - RNA, 27 nt, synthetic construct
  misc_feature 1..27: note = derived and/or modified sequence opt3 from anti-influenza_CDR
  source 1..27: mol_type = other RNA
cagcaaacctacagcacacccatcact

SEQ ID NO: 29852 - RNA, 27 nt, synthetic construct
  misc_feature 1..27: note = derived and/or modified sequence opt3 from anti-influenza_CDR
  source 1..27: mol_type = other RNA
ttcttttacaacggcgggagcaccaag

SEQ ID NO: 29853 - RNA, 27 nt, synthetic construct
  misc_feature 1..27: note = derived and/or modified sequence opt3 from anti-influenza_CDR
  source 1..27: mol_type = other RNA
cagcaaagctacaacacccccctgatc

SEQ ID NO: 29854 - RNA, 27 nt, synthetic construct
  misc_feature 1..27: note = derived and/or modified sequence opt3 from anti-influenza_CDR
  source 1..27: mol_type = other RNA
cacatctacgactatggcagaaccttc

SEQ ID NO: 29855 - RNA, 27 nt, synthetic construct
  misc_feature 1..27: note = derived and/or modified sequence opt3 from anti-influenza_CDR
  source 1..27: mol_type = other RNA
gtgttctacagcgagaccagaacatat

SEQ ID NO: 29856 - RNA, 27 nt, synthetic construct
  misc_feature 1..27: note = derived and/or modified sequence opt3 from anti-influenza_CDR
  source 1..27: mol_type = other RNA
caggtgtggggcagctcctctgaccac

SEQ ID NO: 29857 - RNA, 27 nt, synthetic construct
  misc_feature 1..27: note = derived and/or modified sequence opt3 from anti-influenza_CDR
  source 1..27: mol_type = other RNA
tacgtgtataacagaggcagcaccaag

SEQ ID NO: 29858 - RNA, 27 nt, synthetic construct
  misc_feature 1..27: note = derived and/or modified sequence opt3 from anti-influenza_CDR
  source 1..27: mol_type = other RNA
tacatctataacagaggcagcaccaag

SEQ ID NO: 29859 - RNA, 27 nt, synthetic construct
  misc_feature 1..27: note = derived and/or modified sequence opt3 from anti-influenza_CDR
  source 1..27: mol_type = other RNA
cagcaaagctacaacacccccatcaca

SEQ ID NO: 29860 - RNA, 27 nt, synthetic construct
  misc_feature 1..27: note = derived and/or modified sequence opt3 from anti-influenza_CDR
  source 1..27: mol_type = other RNA
cagcaatactatagctcccctcccacc

SEQ ID NO: 29861 - RNA, 27 nt, synthetic construct
  misc_feature 1..27: note = derived and/or modified sequence opt3 from anti-influenza_CDR
  source 1..27: mol_type = other RNA
tacctgtattacagcggctccaccaag

SEQ ID NO: 29862 - RNA, 27 nt, synthetic construct
  misc_feature 1..27: note = derived and/or modified sequence opt3 from anti-influenza_CDR
  source 1..27: mol_type = other RNA
cagcaaagctactcccctcccatcacc

SEQ ID NO: 29863 - RNA, 27 nt, synthetic construct
  misc_feature 1..27: note = derived and/or modified sequence opt3 from anti-influenza_CDR
  source 1..27: mol_type = other RNA
tacgtgtataacagcggcaataccaag

SEQ ID NO: 29864 - RNA, 27 nt, synthetic construct
  misc_feature 1..27: note = derived and/or modified sequence opt3 from anti-influenza_CDR
  source 1..27: mol_type = other RNA
cagcaaagctacaacacacccctgacc

SEQ ID NO: 29865 - RNA, 27 nt, synthetic construct
  misc_feature 1..27: note = derived and/or modified sequence opt3 from anti-influenza_CDR
  source 1..27: mol_type = other RNA
cacatcttcgacagcggctccacctac

SEQ ID NO: 29866 - RNA, 27 nt, synthetic construct
  misc_feature 1..27: note = derived and/or modified sequence opt3 from anti-influenza_CDR
  source 1..27: mol_type = other RNA
gtgttctacagcgccgacagaacctcc

SEQ ID NO: 29867 - RNA, 27 nt, synthetic construct
  misc_feature 1..27: note = derived and/or modified sequence opt3 from anti-influenza_CDR
  source 1..27: mol_type = other RNA
cagcaatactatagcacacccctgacc

SEQ ID NO: 29868 - RNA, 27 nt, synthetic construct
  misc_feature 1..27: note = derived and/or modified sequence opt3 from anti-influenza_CDR
  source 1..27: mol_type = other RNA
tacatctattacagcggcaacacctat

SEQ ID NO: 29869 - RNA, 27 nt, synthetic construct
  misc_feature 1..27: note = derived and/or modified sequence opt3 from anti-influenza_CDR
  source 1..27: mol_type = other RNA
cagcaaagctactccacacccctgacc

SEQ ID NO: 29870 - RNA, 27 nt, synthetic construct
  misc_feature 1..27: note = derived and/or modified sequence opt3 from anti-influenza_CDR
  source 1..27: mol_type = other RNA
cagcaatacggcagctcctctctgacc

SEQ ID NO: 29871 - RNA, 27 nt, synthetic construct
  misc_feature 1..27: note = derived and/or modified sequence opt3 from anti-influenza_CDR
  source 1..27: mol_type = other RNA
agctcctacacctcttcaagtacatat

SEQ ID NO: 29872 - RNA, 27 nt, synthetic construct
  misc_feature 1..27: note = derived and/or modified sequence opt3 from anti-influenza_CDR
  source 1..27: mol_type = other RNA
cagagatacaacagcgcccctcccatc

SEQ ID NO: 29873 - RNA, 27 nt, synthetic construct
  misc_feature 1..27: note = derived and/or modified sequence opt3 from anti-influenza_CDR
  source 1..27: mol_type = other RNA
cagcaatacggcagaacacccctgacc

SEQ ID NO: 29874 - RNA, 27 nt, synthetic construct
  misc_feature 1..27: note = derived and/or modified sequence opt3 from anti-influenza_CDR
  source 1..27: mol_type = other RNA
cagcaatacggcagctcccccagaacc

SEQ ID NO: 29875 - RNA, 27 nt, synthetic construct
  misc_feature 1..27: note = derived and/or modified sequence opt3 from anti-influenza_CDR
  source 1..27: mol_type = other RNA
cagcaatacggctccagccccctgacc

SEQ ID NO: 29876 - RNA, 27 nt, synthetic construct
  misc_feature 1..27: note = derived and/or modified sequence opt3 from anti-influenza_CDR
  source 1..27: mol_type = other RNA
caggtgtgggacagctcctctgatcac

SEQ ID NO: 29877 - RNA, 27 nt, synthetic construct
  misc_feature 1..27: note = derived and/or modified sequence opt3 from anti-influenza_CDR
  source 1..27: mol_type = other RNA
aaggagttcagcgaagtggagggcaga

SEQ ID NO: 29878 - RNA, 27 nt, synthetic construct
  misc_feature 1..27: note = derived and/or modified sequence opt3 from anti-influenza_CDR
  source 1..27: mol_type = other RNA
aaagagttcaacaatctggaaaagaga

SEQ ID NO: 29879 - RNA, 27 nt, synthetic construct
  misc_feature 1..27: note = derived and/or modified sequence opt3 from anti-influenza_CDR
  source 1..27: mol_type = other RNA
cagcaacactacagaacccctcccagc

SEQ ID NO: 29880 - RNA, 27 nt, synthetic construct
  misc_feature 1..27: note = derived and/or modified sequence opt3 from anti-influenza_CDR
  source 1..27: mol_type = other RNA
atgcaggccacccactggcccctgaca

SEQ ID NO: 29881 - RNA, 27 nt, synthetic construct
  misc_feature 1..27: note = derived and/or modified sequence opt3 from anti-influenza_CDR
  source 1..27: mol_type = other RNA
cagcaatactatagctacccctatacc

SEQ ID NO: 29882 - RNA, 27 nt, synthetic construct
  misc_feature 1..27: note = derived and/or modified sequence opt3 from anti-influenza_CDR
  source 1..27: mol_type = other RNA
agctccgacgtgggcgggtacaactat

SEQ ID NO: 29883 - RNA, 27 nt, synthetic construct
  misc_feature 1..27: note = derived and/or modified sequence opt3 from anti-influenza_CDR
  source 1..27: mol_type = other RNA
agctccgacgtgggcgattacaactat

SEQ ID NO: 29884 - RNA, 27 nt, synthetic construct
  misc_feature 1..27: note = derived and/or modified sequence opt3 from anti-influenza_CDR
  source 1..27: mol_type = other RNA
cagcaatacaacaattggcccctgagc

SEQ ID NO: 29885 - RNA, 27 nt, synthetic construct
  misc_feature 1..27: note = derived and/or modified sequence opt3 from anti-influenza_CDR
  source 1..27: mol_type = other RNA
cagcaaagctacaactatcccagaacc

SEQ ID NO: 29886 - RNA, 27 nt, synthetic construct
  misc_feature 1..27: note = derived and/or modified sequence opt3 from anti-influenza_CDR
  source 1..27: mol_type = other RNA
atgcagggcctgcaaaccccctacaca

SEQ ID NO: 29887 - RNA, 27 nt, synthetic construct
  misc_feature 1..27: note = derived and/or modified sequence opt3 from anti-influenza_CDR
  source 1..27: mol_type = other RNA
cagcaacactacagcatccccctgacc

SEQ ID NO: 29888 - RNA, 27 nt, synthetic construct
  misc_feature 1..27: note = derived and/or modified sequence opt3 from anti-influenza_CDR
  source 1..27: mol_type = other RNA
ctgcagcacaacagctacccctggacc

SEQ ID NO: 29889 - RNA, 27 nt, synthetic construct
  misc_feature 1..27: note = derived and/or modified sequence opt3 from anti-influenza_CDR
  source 1..27: mol_type = other RNA
cagcaatacaacacctggcccctgaca

SEQ ID NO: 29890 - RNA, 27 nt, synthetic construct
  misc_feature 1..27: note = derived and/or modified sequence opt3 from anti-influenza_CDR
  source 1..27: mol_type = other RNA
cagcaatacaacagcttcccctataga

SEQ ID NO: 29891 - RNA, 27 nt, synthetic construct
  misc_feature 1..27: note = derived and/or modified sequence opt3 from anti-influenza_CDR
  source 1..27: mol_type = other RNA
cagcaaagctactccgcccccttcacc

SEQ ID NO: 29892 - RNA, 27 nt, synthetic construct
  misc_feature 1..27: note = derived and/or modified sequence opt3 from anti-influenza_CDR
  source 1..27: mol_type = other RNA
caggcctgggacagctccaccgtggtc

SEQ ID NO: 29893 - RNA, 27 nt, synthetic construct
  misc_feature 1..27: note = derived and/or modified sequence opt3 from anti-influenza_CDR
  source 1..27: mol_type = other RNA
caggcctgggacagcaccacagtggtc

SEQ ID NO: 29894 - RNA, 27 nt, synthetic construct
  misc_feature 1..27: note = derived and/or modified sequence opt3 from anti-influenza_CDR
  source 1..27: mol_type = other RNA
ctgcagtacggcagctcccccagaacc

SEQ ID NO: 29895 - RNA, 27 nt, synthetic construct
  misc_feature 1..27: note = derived and/or modified sequence opt3 from anti-influenza_CDR
  source 1..27: mol_type = other RNA
agctccgacgtgggcgggtacgattat

SEQ ID NO: 29896 - RNA, 27 nt, synthetic construct
  misc_feature 1..27: note = derived and/or modified sequence opt3 from anti-influenza_CDR
  source 1..27: mol_type = other RNA
cagcaatacacctattggcccctgaca

SEQ ID NO: 29897 - RNA, 27 nt, synthetic construct
  misc_feature 1..27: note = derived and/or modified sequence opt3 from anti-influenza_CDR
  source 1..27: mol_type = other RNA
cagcaatacgacaagtggccccctggc

SEQ ID NO: 29898 - RNA, 27 nt, synthetic construct
  misc_feature 1..27: note = derived and/or modified sequence opt3 from anti-influenza_CDR
  source 1..27: mol_type = other RNA
atgcagagcctgcaaacctccatcaca

SEQ ID NO: 29899 - RNA, 27 nt, synthetic construct
  misc_feature 1..27: note = derived and/or modified sequence opt3 from anti-influenza_CDR
  source 1..27: mol_type = other RNA
agccagatcgagctggccgtgctcctt

SEQ ID NO: 29900 - RNA, 27 nt, synthetic construct
  misc_feature 1..27: note = derived and/or modified sequence opt3 from anti-influenza_CDR
  source 1..27: mol_type = other RNA
atgcaggccctgcaaaccccctacaca

SEQ ID NO: 29901 - RNA, 27 nt, synthetic construct
  misc_feature 1..27: note = derived and/or modified sequence opt3 from anti-influenza_CDR
  source 1..27: mol_type = other RNA
cagcaaagaagccactggccccctatc

SEQ ID NO: 29902 - RNA, 27 nt, synthetic construct
  misc_feature 1..27: note = derived and/or modified sequence opt3 from anti-influenza_CDR
  source 1..27: mol_type = other RNA
cagcacttctggggcacacccctgacc

SEQ ID NO: 29903 - RNA, 27 nt, synthetic construct
  misc_feature 1..27: note = derived and/or modified sequence opt3 from anti-influenza_CDR
  source 1..27: mol_type = other RNA
cagcaaaactacgaggacccctggacc

SEQ ID NO: 29904 - RNA, 27 nt, synthetic construct
  misc_feature 1..27: note = derived and/or modified sequence opt3 from anti-influenza_CDR
  source 1..27: mol_type = other RNA
cagcaagccaacagcttccctcccacc

SEQ ID NO: 29905 - RNA, 27 nt, synthetic construct
  misc_feature 1..27: note = derived and/or modified sequence opt3 from anti-influenza_CDR
  source 1..27: mol_type = other RNA
cagcaaagagaccactggccccctatc

SEQ ID NO: 29906 - RNA, 27 nt, synthetic construct
  misc_feature 1..27: note = derived and/or modified sequence opt3 from anti-influenza_CDR
  source 1..27: mol_type = other RNA
atggacagcagactgaacctcgtgttc

SEQ ID NO: 29907 - RNA, 27 nt, synthetic construct
  misc_feature 1..27: note = derived and/or modified sequence opt3 from anti-influenza_CDR
  source 1..27: mol_type = other RNA
atgaagctgcccgtgagactccttgtc

SEQ ID NO: 29908 - RNA, 30 nt, synthetic construct
  misc_feature 1..30: note = derived and/or modified sequence opt3 from anti-influenza_CDR
  source 1..30: mol_type = other RNA
ggcgacagcgtgaccagagggggattctac

SEQ ID NO: 29909 - RNA, 30 nt, synthetic construct
  misc_feature 1..30: note = derived and/or modified sequence opt3 from anti-influenza_CDR
  source 1..30: mol_type = other RNA
cagagcgtgaccttcaacaataagaactac

SEQ ID NO: 29910 - RNA, 30 nt, synthetic construct
  misc_feature 1..30: note = derived and/or modified sequence opt3 from anti-influenza_CDR
  source 1..30: mol_type = other RNA
cagagcgtgaccttcaactacaagaattat

SEQ ID NO: 29911 - RNA, 30 nt, synthetic construct
  misc_feature 1..30: note = derived and/or modified sequence opt3 from anti-influenza_CDR
  source 1..30: mol_type = other RNA
agagcccagagcctgtcctcttacctccac

SEQ ID NO: 29912 - RNA, 30 nt, synthetic construct
  misc_feature 1..30: note = derived and/or modified sequence opt3 from anti-influenza_CDR
  source 1..30: mol_type = other RNA
agctcctacacctcttcaagtacatatgtg

SEQ ID NO: 29913 - RNA, 30 nt, synthetic construct
  misc_feature 1..30: note = derived and/or modified sequence opt3 from anti-influenza_CDR
  source 1..30: mol_type = other RNA
cagagatacaacagcgcccctcccatcacc

SEQ ID NO: 29914 - RNA, 30 nt, synthetic construct
  misc_feature 1..30: note = derived and/or modified sequence opt3 from anti-influenza_CDR
  source 1..30: mol_type = other RNA
ggcgggagcatctcctctggaacctactat

SEQ ID NO: 29915 - RNA, 30 nt, synthetic construct
  misc_feature 1..30: note = derived and/or modified sequence opt3 from anti-influenza_CDR
  source 1..30: mol_type = other RNA
cagcaaagctactcctctctgatgttcacc

SEQ ID NO: 29916 - RNA, 30 nt, synthetic construct
  misc_feature 1..30: note = derived and/or modified sequence opt3 from anti-influenza_CDR
  source 1..30: mol_type = other RNA
ctgctcatctacggcgccagcaccagagct

SEQ ID NO: 29917 - RNA, 30 nt, synthetic construct
  misc_feature 1..30: note = derived and/or modified sequence opt3 from anti-influenza_CDR
  source 1..30: mol_type = other RNA
tgcgcctacggcgggaagtatctggtggtc

SEQ ID NO: 29918 - RNA, 30 nt, synthetic construct
  misc_feature 1..30: note = derived and/or modified sequence opt3 from anti-influenza_CDR
  source 1..30: mol_type = other RNA
agacccgacttctacggcgattttgagtat

SEQ ID NO: 29919 - RNA, 30 nt, synthetic construct
  misc_feature 1..30: note = derived and/or modified sequence opt3 from anti-influenza_CDR
  source 1..30: mol_type = other RNA
cagcactacggctatagccccagatacgcc

SEQ ID NO: 29920 - RNA, 30 nt, synthetic construct
  misc_feature 1..30: note = derived and/or modified sequence opt3 from anti-influenza_CDR
  source 1..30: mol_type = other RNA
cagcaaagaagccactggccccctatcacc

SEQ ID NO: 29921 - RNA, 30 nt, synthetic construct
  misc_feature 1..30: note = derived and/or modified sequence opt3 from anti-influenza_CDR
  source 1..30: mol_type = other RNA
agctcctacgccggctcatctacctgggtg

SEQ ID NO: 29922 - RNA, 30 nt, synthetic construct; identical to SEQ ID NO: 14638
  misc_feature 1..30: note = derived and/or modified sequence opt3 from anti-influenza_CDR
  source 1..30: mol_type = other RNA

SEQ ID NO: 29923 - RNA, 30 nt, synthetic construct
  misc_feature 1..30: note = derived and/or modified sequence opt3 from anti-influenza_CDR
  source 1..30: mol_type = other RNA
cagcaatacggcgggagccccagatatacc

SEQ ID NO: 29924 - RNA, 30 nt, synthetic construct
  misc_feature 1..30: note = derived and/or modified sequence opt3 from anti-influenza_CDR
  source 1..30: mol_type = other RNA
agatacggcagcgggtatggattcgactcc

SEQ ID NO: 29925 - RNA, 30 nt, synthetic construct
  misc_feature 1..30: note = derived and/or modified sequence opt3 from anti-influenza_CDR
  source 1..30: mol_type = other RNA
agctcctacgccggcaactataatcacgtg

SEQ ID NO: 29926 - RNA, 30 nt, synthetic construct
  misc_feature 1..30: note = derived and/or modified sequence opt3 from anti-influenza_CDR
  source 1..30: mol_type = other RNA
cagcaatacatcaactggagacccctgagc

SEQ ID NO: 29927 - RNA, 30 nt, synthetic construct
  misc_feature 1..30: note = derived and/or modified sequence opt3 from anti-influenza_CDR
  source 1..30: mol_type = other RNA
atcggcgccgggtacgacgtgcactggtat

SEQ ID NO: 29928 - RNA, 30 nt, synthetic construct
  misc_feature 1..30: note = derived and/or modified sequence opt3 from anti-influenza_CDR
  source 1..30: mol_type = other RNA
ctgctcatctacgacaacaataacagaccc

SEQ ID NO: 29929 - RNA, 30 nt, synthetic construct
  misc_feature 1..30: note = derived and/or modified sequence opt3 from anti-influenza_CDR
  source 1..30: mol_type = other RNA
cagagctacgacaactccctgtctggctca

SEQ ID NO: 29930 - RNA, 30 nt, synthetic construct
  misc_feature 1..30: note = derived and/or modified sequence opt3 from anti-influenza_CDR
  source 1..30: mol_type = other RNA
ctgctcatctacgacgccagcaaccttcag

SEQ ID NO: 29931 - RNA, 30 nt, synthetic construct
  misc_feature 1..30: note = derived and/or modified sequence opt3 from anti-influenza_CDR
  source 1..30: mol_type = other RNA
ctgctcatccacgacgccagcaaccttgag

SEQ ID NO: 29932 - RNA, 30 nt, synthetic construct
  misc_feature 1..30: note = derived and/or modified sequence opt3 from anti-influenza_CDR
  source 1..30: mol_type = other RNA
gtgcagagactgagctacggcatggacgtc

SEQ ID NO: 29933 - RNA, 30 nt, synthetic construct
  misc_feature 1..30: note = derived and/or modified sequence opt3 from anti-influenza_CDR
  source 1..30: mol_type = other RNA
gtgcagaagagctactatggcatggacgtc

SEQ ID NO: 29934 - RNA, 30 nt, synthetic construct
  misc_feature 1..30: note = derived and/or modified sequence opt3 from anti-influenza_CDR
  source 1..30: mol_type = other RNA
agctcctacacctcttcaagtacacacgtg

SEQ ID NO: 29935 - RNA, 30 nt, synthetic construct
  misc_feature 1..30: note = derived and/or modified sequence opt3 from anti-influenza_CDR
  source 1..30: mol_type = other RNA
agctcctacacctcttcaagtacactggtg

SEQ ID NO: 29936 - RNA, 30 nt, synthetic construct
  misc_feature 1..30: note = derived and/or modified sequence opt3 from anti-influenza_CDR
  source 1..30: mol_type = other RNA
accaagagaagccagcaaacagtgatcccc

SEQ ID NO: 29937 - RNA, 30 nt, synthetic construct
  misc_feature 1..30: note = derived and/or modified sequence opt3 from anti-influenza_CDR
  source 1..30: mol_type = other RNA
accagcagatcccagcaaacagtgatcccc

SEQ ID NO: 29938 - RNA, 30 nt, synthetic construct
  misc_feature 1..30: note = derived and/or modified sequence opt3 from anti-influenza_CDR
  source 1..30: mol_type = other RNA
agctccaactacaatagaaggttcaccccc

SEQ ID NO: 29939 - RNA, 30 nt, synthetic construct
  misc_feature 1..30: note = derived and/or modified sequence opt3 from anti-influenza_CDR
  source 1..30: mol_type = other RNA
agacccaaggtgagggaccaggagagccgg

SEQ ID NO: 29940 - RNA, 30 nt, synthetic construct
  misc_feature 1..30: note = derived and/or modified sequence opt3 from anti-influenza_CDR
  source 1..30: mol_type = other RNA
agaccctgggtgaggggcgtcagctcccgg

SEQ ID NO: 29941 - RNA, 30 nt, synthetic construct
  misc_feature 1..30: note = derived and/or modified sequence opt3 from anti-influenza_CDR
  source 1..30: mol_type = other RNA
agaccctgggtgaggggcctgagctcccgg

SEQ ID NO: 29942 - RNA, 30 nt, synthetic construct
  misc_feature 1..30: note = derived and/or modified sequence opt3 from anti-influenza_CDR
  source 1..30: mol_type = other RNA
agacccaaggtgaggggccaggccgggcgg

SEQ ID NO: 29943 - RNA, 30 nt, synthetic construct
  misc_feature 1..30: note = derived and/or modified sequence opt3 from anti-influenza_CDR
  source 1..30: mol_type = other RNA
gcccccgctgtggcagcccaggcgagcgct

SEQ ID NO: 29944 - RNA, 30 nt, synthetic construct
  misc_feature 1..30: note = derived and/or modified sequence opt3 from anti-influenza_CDR
  source 1..30: mol_type = other RNA
gtgcaccatcccggcaccgacaacgatcag

SEQ ID NO: 29945 - RNA, 30 nt, synthetic construct
  misc_feature 1..30: note = derived and/or modified sequence opt3 from anti-influenza_CDR
  source 1..30: mol_type = other RNA
ttcggccaggggaccaaggtggagatcaaa

SEQ ID NO: 29946 - RNA, 30 nt, synthetic construct
  misc_feature 1..30: note = derived and/or modified sequence opt3 from anti-influenza_CDR
  source 1..30: mol_type = other RNA
ggcttcgcctttcacaacagagctatgcat

SEQ ID NO: 29947 - RNA, 30 nt, synthetic construct; identical to SEQ ID NO: 14663
  misc_feature 1..30: note = derived and/or modified sequence opt3 from anti-influenza_CDR
  source 1..30: mol_type = other RNA

SEQ ID NO: 29948 - RNA, 30 nt, synthetic construct; identical to SEQ ID NO: 14664
  misc_feature 1..30: note = derived and/or modified sequence opt3 from anti-influenza_CDR
  source 1..30: mol_type = other RNA

SEQ ID NO: 29949 - RNA, 30 nt, synthetic construct
  misc_feature 1..30: note = derived and/or modified sequence opt3 from anti-influenza_CDR
  source 1..30: mol_type = other RNA
ggcagcatcttctccaactacgggatttct

SEQ ID NO: 29950 - RNA, 30 nt, synthetic construct
  misc_feature 1..30: note = derived and/or modified sequence opt3 from anti-influenza_CDR
  source 1..30: mol_type = other RNA
ggctacagcttcaacaattatgggatcaac

SEQ ID NO: 29951 - RNA, 30 nt, synthetic construct
  misc_feature 1..30: note = derived and/or modified sequence opt3 from anti-influenza_CDR
  source 1..30: mol_type = other RNA
ggctacaccttcaacgcctattacatccac

SEQ ID NO: 29952 - RNA, 30 nt, synthetic construct
  misc_feature 1..30: note = derived and/or modified sequence opt3 from anti-influenza_CDR
  source 1..30: mol_type = other RNA
ggctacacattcaccagctttatcatgtat

SEQ ID NO: 29953 - RNA, 30 nt, synthetic construct
  misc_feature 1..30: note = derived and/or modified sequence opt3 from anti-influenza_CDR
  source 1..30: mol_type = other RNA
agaggcaactacgggaatggattcgcctat

SEQ ID NO: 29954 - RNA, 30 nt, synthetic construct
  misc_feature 1..30: note = derived and/or modified sequence opt3 from anti-influenza_CDR
  source 1..30: mol_type = other RNA
cagcaatacggcagctcccccgccctgacc

SEQ ID NO: 29955 - RNA, 30 nt, synthetic construct
  misc_feature 1..30: note = derived and/or modified sequence opt3 from anti-influenza_CDR
  source 1..30: mol_type = other RNA
caggagtacaacaatgacagccccctgacc

SEQ ID NO: 29956 - RNA, 30 nt, synthetic construct
  misc_feature 1..30: note = derived and/or modified sequence opt3 from anti-influenza_CDR
  source 1..30: mol_type = other RNA
atcagaagcggcctgaacaggttcgagacc

SEQ ID NO: 29957 - RNA, 30 nt, synthetic construct
  misc_feature 1..30: note = derived and/or modified sequence opt3 from anti-influenza_CDR
  source 1..30: mol_type = other RNA
gtgttctacagcggctcctctaactataat

SEQ ID NO: 29958 - RNA, 30 nt, synthetic construct
  misc_feature 1..30: note = derived and/or modified sequence opt3 from anti-influenza_CDR
  source 1..30: mol_type = other RNA
ggcgccagcatctccaccgggggaaactac

SEQ ID NO: 29959 - RNA, 30 nt, synthetic construct
  misc_feature 1..30: note = derived and/or modified sequence opt3 from anti-influenza_CDR
  source 1..30: mol_type = other RNA
atcttctacagcggcaccacaaagtataac

SEQ ID NO: 29960 - RNA, 30 nt, synthetic construct
  misc_feature 1..30: note = derived and/or modified sequence opt3 from anti-influenza_CDR
  source 1..30: mol_type = other RNA
gccagctacgctggcacctatatccacctg

SEQ ID NO: 29961 - RNA, 30 nt, synthetic construct
  misc_feature 1..30: note = derived and/or modified sequence opt3 from anti-influenza_CDR
  source 1..30: mol_type = other RNA
cagcaactgaacagctaccctcccatcacc

SEQ ID NO: 29962 - RNA, 30 nt, synthetic construct
  misc_feature 1..30: note = derived and/or modified sequence opt3 from anti-influenza_CDR
  source 1..30: mol_type = other RNA
cagcaattcaacgactggccctttctgacc

SEQ ID NO: 29963 - RNA, 30 nt, synthetic construct
  misc_feature 1..30: note = derived and/or modified sequence opt3 from anti-influenza_CDR
  source 1..30: mol_type = other RNA
cagcaactgaccacataccctcccatcact

SEQ ID NO: 29964 - RNA, 30 nt, synthetic construct
  misc_feature 1..30: note = derived and/or modified sequence opt3 from anti-influenza_CDR
  source 1..30: mol_type = other RNA
ggcgggagcatctccaacggaggttaccac

SEQ ID NO: 29965 - RNA, 30 nt, synthetic construct
  misc_feature 1..30: note = derived and/or modified sequence opt3 from anti-influenza_CDR
  source 1..30: mol_type = other RNA
ggcgacagcgtgatcaactccgcctactat

SEQ ID NO: 29966 - RNA, 30 nt, synthetic construct
  misc_feature 1..30: note = derived and/or modified sequence opt3 from anti-influenza_CDR
  source 1..30: mol_type = other RNA
cagcaatacgacaactggctgcccatcacc

SEQ ID NO: 29967 - RNA, 30 nt, synthetic construct
  misc_feature 1..30: note = derived and/or modified sequence opt3 from anti-influenza_CDR
  source 1..30: mol_type = other RNA
gccggcgactacagcgggggaatctatgct

SEQ ID NO: 29968 - RNA, 30 nt, synthetic construct
  misc_feature 1..30: note = derived and/or modified sequence opt3 from anti-influenza_CDR
  source 1..30: mol_type = other RNA
gccggcgactacagcgggtccaactatgct

SEQ ID NO: 29969 - RNA, 30 nt, synthetic construct
  misc_feature 1..30: note = derived and/or modified sequence opt3 from anti-influenza_CDR
  source 1..30: mol_type = other RNA
gccggcgactacagcggggctaactatgca

SEQ ID NO: 29970 - RNA, 30 nt, synthetic construct
  misc_feature 1..30: note = derived and/or modified sequence opt3 from anti-influenza_CDR
  source 1..30: mol_type = other RNA
ggcctgagcctctactccaacgagatcaat

SEQ ID NO: 29971 - RNA, 30 nt, synthetic construct
  misc_feature 1..30: note = derived and/or modified sequence opt3 from anti-influenza_CDR
  source 1..30: mol_type = other RNA
gccagctacgctggcaacaatatctatgtg

SEQ ID NO: 29972 - RNA, 30 nt, synthetic construct
  misc_feature 1..30: note = derived and/or modified sequence opt3 from anti-influenza_CDR
  source 1..30: mol_type = other RNA
gccagccagtccgtgtctaccttcctggct

SEQ ID NO: 29973 - RNA, 30 nt, synthetic construct
  misc_feature 1..30: note = derived and/or modified sequence opt3 from anti-influenza_CDR
  source 1..30: mol_type = other RNA
atcaagagcaacaccgacggcgggacaact

SEQ ID NO: 29974 - RNA, 30 nt, synthetic construct; identical to SEQ ID NO: 14690
  misc_feature 1..30: note = derived and/or modified sequence opt3 from anti-influenza_CDR
  source 1..30: mol_type = other RNA

SEQ ID NO: 29975 - RNA, 30 nt, synthetic construct
  misc_feature 1..30: note = derived and/or modified sequence opt3 from anti-influenza_CDR
  source 1..30: mol_type = other RNA
gagagcatcgacatttacggcaactccttc

SEQ ID NO: 29976 - RNA, 30 nt, synthetic construct
  misc_feature 1..30: note = derived and/or modified sequence opt3 from anti-influenza_CDR
  source 1..30: mol_type = other RNA
gccggcgactacagcggggtgaactatgct

SEQ ID NO: 29977 - RNA, 33 nt, synthetic construct
  misc_feature 1..33: note = derived and/or modified sequence opt3 from anti-influenza_CDR
  source 1..33: mol_type = other RNA
gccgcttgggacgatagcctgaacggccagctc

SEQ ID NO: 29978 - RNA, 33 nt, synthetic construct
  misc_feature 1..33: note = derived and/or modified sequence opt3 from anti-influenza_CDR
  source 1..33: mol_type = other RNA
tgcagctacgccggctcctcttcaagtagagtg

SEQ ID NO: 29979 - RNA, 33 nt, synthetic construct
  misc_feature 1..33: note = derived and/or modified sequence opt3 from anti-influenza_CDR
  source 1..33: mol_type = other RNA
ctggtgctcgccaccggccttagaaacagcccc

SEQ ID NO: 29980 - RNA, 33 nt, synthetic construct; identical to SEQ ID NO: 14696
  misc_feature 1..33: note = derived and/or modified sequence opt3 from anti-influenza_CDR
  source 1..33: mol_type = other RNA

SEQ ID NO: 29981 - RNA, 33 nt, synthetic construct
  misc_feature 1..33: note = derived and/or modified sequence opt3 from anti-influenza_CDR
  source 1..33: mol_type = other RNA
agaaccagccagtccctgtcttcatacctccac

SEQ ID NO: 29982 - RNA, 33 nt, synthetic construct
  misc_feature 1..33: note = derived and/or modified sequence opt3 from anti-influenza_CDR
  source 1..33: mol_type = other RNA
agagccagccagaggctgaactcctacctccac

SEQ ID NO: 29983 - RNA, 33 nt, synthetic construct
  misc_feature 1..33: note = derived and/or modified sequence opt3 from anti-influenza_CDR
  source 1..33: mol_type = other RNA
agaaccagccagtccctgaggtcttacctccac

SEQ ID NO: 29984 - RNA, 33 nt, synthetic construct
  misc_feature 1..33: note = derived and/or modified sequence opt3 from anti-influenza_CDR
  source 1..33: mol_type = other RNA
agaaccagccagtccctgtcttcatacacacac

SEQ ID NO: 29985 - RNA, 33 nt, synthetic construct
  misc_feature 1..33: note = derived and/or modified sequence opt3 from anti-influenza_CDR
  source 1..33: mol_type = other RNA
agaaccagccagtccctgtcttcatacgaccac

SEQ ID NO: 29986 - RNA, 33 nt, synthetic construct
  misc_feature 1..33: note = derived and/or modified sequence opt3 from anti-influenza_CDR
  source 1..33: mol_type = other RNA
caggtgtgggacagctcctctgatcactacgtc

SEQ ID NO: 29987 - RNA, 33 nt, synthetic construct
  misc_feature 1..33: note = derived and/or modified sequence opt3 from anti-influenza_CDR
  source 1..33: mol_type = other RNA
caggtgtggggcagctcctctgaccactacgtc

SEQ ID NO: 29988 - RNA, 33 nt, synthetic construct
  misc_feature 1..33: note = derived and/or modified sequence opt3 from anti-influenza_CDR
  source 1..33: mol_type = other RNA
ggcacctgggacagctccctgtctgtggggatg

SEQ ID NO: 29989 - RNA, 33 nt, synthetic construct
  misc_feature 1..33: note = derived and/or modified sequence opt3 from anti-influenza_CDR
  source 1..33: mol_type = other RNA
cagagcctgctccacggcaacgggtacaattat

SEQ ID NO: 29990 - RNA, 33 nt, synthetic construct
  misc_feature 1..33: note = derived and/or modified sequence opt3 from anti-influenza_CDR
  source 1..33: mol_type = other RNA
agagccagccagggcatcaggaacgacctgggg

SEQ ID NO: 29991 - RNA, 33 nt, synthetic construct
  misc_feature 1..33: note = derived and/or modified sequence opt3 from anti-influenza_CDR
  source 1..33: mol_type = other RNA
agagccagccagaacatcaggtcctacctgaat

SEQ ID NO: 29992 - RNA, 33 nt, synthetic construct
  misc_feature 1..33: note = derived and/or modified sequence opt3 from anti-influenza_CDR
  source 1..33: mol_type = other RNA
agagccaaccaggacatcggcatttacctgaat

SEQ ID NO: 29993 - RNA, 33 nt, synthetic construct
  misc_feature 1..33: note = derived and/or modified sequence opt3 from anti-influenza_CDR
  source 1..33: mol_type = other RNA
agagccagccagtccgtgtctaacaatctggct

SEQ ID NO: 29994 - RNA, 33 nt, synthetic construct
  misc_feature 1..33: note = derived and/or modified sequence opt3 from anti-influenza_CDR
  source 1..33: mol_type = other RNA
cagcaataccacaactggccccctagctattcc

SEQ ID NO: 29995 - RNA, 33 nt, synthetic construct
  misc_feature 1..33: note = derived and/or modified sequence opt3 from anti-influenza_CDR
  source 1..33: mol_type = other RNA
agagccagccagggcatcctgaactgcctcgct

SEQ ID NO: 29996 - RNA, 33 nt, synthetic construct
  misc_feature 1..33: note = derived and/or modified sequence opt3 from anti-influenza_CDR
  source 1..33: mol_type = other RNA
agagccagccagtccatcgcttcttggctggca

SEQ ID NO: 29997 - RNA, 33 nt, synthetic construct
  misc_feature 1..33: note = derived and/or modified sequence opt3 from anti-influenza_CDR
  source 1..33: mol_type = other RNA
gcccccagagtgtacgagtattacttcgaccag

SEQ ID NO: 29998 - RNA, 33 nt, synthetic construct
  misc_feature 1..33: note = derived and/or modified sequence opt3 from anti-influenza_CDR
  source 1..33: mol_type = other RNA
agagccagccagtccgtgtcttcatacctggct

SEQ ID NO: 29999 - RNA, 33 nt, synthetic construct
  misc_feature 1..33: note = derived and/or modified sequence opt3 from anti-influenza_CDR
  source 1..33: mol_type = other RNA
agcggcgacgccctgcccaagcagaacgcttac

SEQ ID NO: 30000 - RNA, 33 nt, synthetic construct
  misc_feature 1..33: note = derived and/or modified sequence opt3 from anti-influenza_CDR
  source 1..33: mol_type = other RNA
cagagcgccgactcctctggcacctcatgggtg

SEQ ID NO: 30001 - RNA, 33 nt, synthetic construct
  misc_feature 1..33: note = derived and/or modified sequence opt3 from anti-influenza_CDR
  source 1..33: mol_type = other RNA
ggcgggagcaacatcggaggtaagtccgtgcac

SEQ ID NO: 30002 - RNA, 33 nt, synthetic construct
  misc_feature 1..33: note = derived and/or modified sequence opt3 from anti-influenza_CDR
  source 1..33: mol_type = other RNA
cagcactacggcagctcccccagatatgccttc

SEQ ID NO: 30003 - RNA, 33 nt, synthetic construct
  misc_feature 1..33: note = derived and/or modified sequence opt3 from anti-influenza_CDR
  source 1..33: mol_type = other RNA
agagccagccagtccatctcttcatacctgaac

SEQ ID NO: 30004 - RNA, 33 nt, synthetic construct
  misc_feature 1..33: note = derived and/or modified sequence opt3 from anti-influenza_CDR
  source 1..33: mol_type = other RNA
ggcgggaacgccatcggaagcaagaaagtgcac

SEQ ID NO: 30005 - RNA, 33 nt, synthetic construct
  misc_feature 1..33: note = derived and/or modified sequence opt3 from anti-influenza_CDR
  source 1..33: mol_type = other RNA
caggtgtgggacttcaccatcgatcacgtcgtt

SEQ ID NO: 30006 - RNA, 33 nt, synthetic construct
  misc_feature 1..33: note = derived and/or modified sequence opt3 from anti-influenza_CDR
  source 1..33: mol_type = other RNA
gccacctgggacggcagcctgtccgcttgggtg

SEQ ID NO: 30007 - RNA, 33 nt, synthetic construct
  misc_feature 1..33: note = derived and/or modified sequence opt3 from anti-influenza_CDR
  source 1..33: mol_type = other RNA
agagccagccagtccgtgggcaactacctggct

SEQ ID NO: 30008 - RNA, 33 nt, synthetic construct
  misc_feature 1..33: note = derived and/or modified sequence opt3 from anti-influenza_CDR
  source 1..33: mol_type = other RNA
cagcaaagaagcaagtggccccctatgtactcc

SEQ ID NO: 30009 - RNA, 33 nt, synthetic construct
  misc_feature 1..33: note = derived and/or modified sequence opt3 from anti-influenza_CDR
  source 1..33: mol_type = other RNA
gacgtgagcaccacatggtcctggttcgccccc

SEQ ID NO: 30010 - RNA, 33 nt, synthetic construct
  misc_feature 1..33: note = derived and/or modified sequence opt3 from anti-influenza_CDR
  source 1..33: mol_type = other RNA
agagccagccagaacatcaagaggtacttcaat

SEQ ID NO: 30011 - RNA, 33 nt, synthetic construct
  misc_feature 1..33: note = derived and/or modified sequence opt3 from anti-influenza_CDR
  source 1..33: mol_type = other RNA
agagccagccagtccgtgggcaactctctggct

SEQ ID NO: 30012 - RNA, 33 nt, synthetic construct
  misc_feature 1..33: note = derived and/or modified sequence opt3 from anti-influenza_CDR
  source 1..33: mol_type = other RNA
ggcgagagcaccctgtcctactatgccgtgtct

SEQ ID NO: 30013 - RNA, 33 nt, synthetic construct
  misc_feature 1..33: note = derived and/or modified sequence opt3 from anti-influenza_CDR
  source 1..33: mol_type = other RNA
agagccagccagaacatctacaagtatctgaat

SEQ ID NO: 30014 - RNA, 33 nt, synthetic construct
  misc_feature 1..33: note = derived and/or modified sequence opt3 from anti-influenza_CDR
  source 1..33: mol_type = other RNA
gccagctgctccggcgggtactgtatcctggac

SEQ ID NO: 30015 - RNA, 33 nt, synthetic construct
  misc_feature 1..33: note = derived and/or modified sequence opt3 from anti-influenza_CDR
  source 1..33: mol_type = other RNA
agaaccagccagtccatctcttcatacctgaac

SEQ ID NO: 30016 - RNA, 33 nt, synthetic construct
  misc_feature 1..33: note = derived and/or modified sequence opt3 from anti-influenza_CDR
  source 1..33: mol_type = other RNA
agagccagccagtccatcggcgcttacgtgaac

SEQ ID NO: 30017 - RNA, 33 nt, synthetic construct
  misc_feature 1..33: note = derived and/or modified sequence opt3 from anti-influenza_CDR
  source 1..33: mol_type = other RNA
agagccagccagtccatctctacctacctgaac

SEQ ID NO: 30018 - RNA, 33 nt, synthetic construct
  misc_feature 1..33: note = derived and/or modified sequence opt3 from anti-influenza_CDR
  source 1..33: mol_type = other RNA
agagccagccagtccatcgacaagttcctgaac

SEQ ID NO: 30019 - RNA, 33 nt, synthetic construct
  misc_feature 1..33: note = derived and/or modified sequence opt3 from anti-influenza_CDR
  source 1..33: mol_type = other RNA
ggcgggcacaacatcggaagcaattccgtgcat

SEQ ID NO: 30020 - RNA, 33 nt, synthetic construct
  misc_feature 1..33: note = derived and/or modified sequence opt3 from anti-influenza_CDR
  source 1..33: mol_type = other RNA
agagccagccagtccatctctacctacctgcac

SEQ ID NO: 30021 - RNA, 33 nt, synthetic construct
  misc_feature 1..33: note = derived and/or modified sequence opt3 from anti-influenza_CDR
  source 1..33: mol_type = other RNA
cacgtgggcgggcatacctacggaatcgactat

SEQ ID NO: 30022 - RNA, 33 nt, synthetic construct
  misc_feature 1..33: note = derived and/or modified sequence opt3 from anti-influenza_CDR
  source 1..33: mol_type = other RNA
agagccagccagtccatctctaactacctgaat

SEQ ID NO: 30023 - RNA, 33 nt, synthetic construct
  misc_feature 1..33: note = derived and/or modified sequence opt3 from anti-influenza_CDR
  source 1..33: mol_type = other RNA
cacgacgatgccagccatggctactccatctct

SEQ ID NO: 30024 - RNA, 33 nt, synthetic construct
  misc_feature 1..33: note = derived and/or modified sequence opt3 from anti-influenza_CDR
  source 1..33: mol_type = other RNA
agagccagccagaccatctccacatacctgaac

SEQ ID NO: 30025 - RNA, 33 nt, synthetic construct
  misc_feature 1..33: note = derived and/or modified sequence opt3 from anti-influenza_CDR
  source 1..33: mol_type = other RNA
agagccagccagtccatctctaggtacctgaac

SEQ ID NO: 30026 - RNA, 33 nt, synthetic construct
  misc_feature 1..33: note = derived and/or modified sequence opt3 from anti-influenza_CDR
  source 1..33: mol_type = other RNA
ggcacctgggacagctccctgtctgcctacgtg

SEQ ID NO: 30027 - RNA, 33 nt, synthetic construct
  misc_feature 1..33: note = derived and/or modified sequence opt3 from anti-influenza_CDR
  source 1..33: mol_type = other RNA
agctccaactactatgactctgtgtacgattat

SEQ ID NO: 30028 - RNA, 33 nt, synthetic construct
  misc_feature 1..33: note = derived and/or modified sequence opt3 from anti-influenza_CDR
  source 1..33: mol_type = other RNA
gccgcttgggacgatatcctgaacgtgcccgtc

SEQ ID NO: 30029 - RNA, 33 nt, synthetic construct
  misc_feature 1..33: note = derived and/or modified sequence opt3 from anti-influenza_CDR
  source 1..33: mol_type = other RNA
gtggcctgggacgatagcgtcgacggctacgtt

SEQ ID NO: 30030 - RNA, 33 nt, synthetic construct
  misc_feature 1..33: note = derived and/or modified sequence opt3 from anti-influenza_CDR
  source 1..33: mol_type = other RNA
ggccccaagtactatagcgagtacatggacgtg

SEQ ID NO: 30031 - RNA, 33 nt, synthetic construct
  misc_feature 1..33: note = derived and/or modified sequence opt3 from anti-influenza_CDR
  source 1..33: mol_type = other RNA
agagccagccagggcatctcctcttacctggct

SEQ ID NO: 30032 - RNA, 33 nt, synthetic construct
  misc_feature 1..33: note = derived and/or modified sequence opt3 from anti-influenza_CDR
  source 1..33: mol_type = other RNA
agctccggctactatcccgagtacttccaggac

SEQ ID NO: 30033 - RNA, 33 nt, synthetic construct
  misc_feature 1..33: note = derived and/or modified sequence opt3 from anti-influenza_CDR
  source 1..33: mol_type = other RNA
agcggccacaagctgggggacaaatacgtgtcc

SEQ ID NO: 30034 - RNA, 33 nt, synthetic construct
  misc_feature 1..33: note = derived and/or modified sequence opt3 from anti-influenza_CDR
  source 1..33: mol_type = other RNA
agcaccggctactatcccgcctacctgcaccat

SEQ ID NO: 30035 - RNA, 33 nt, synthetic construct
  misc_feature 1..33: note = derived and/or modified sequence opt3 from anti-influenza_CDR
  source 1..33: mol_type = other RNA
agagccagccagagggtgtcctcttacctggct

SEQ ID NO: 30036 - RNA, 33 nt, synthetic construct; identical to SEQ ID NO: 28929
  misc_feature 1..33: note = derived and/or modified sequence opt3 from anti-influenza_CDR
  source 1..33: mol_type = other RNA

SEQ ID NO: 30037 - RNA, 33 nt, synthetic construct
  misc_feature 1..33: note = derived and/or modified sequence opt3 from anti-influenza_CDR
  source 1..33: mol_type = other RNA
caggtgtgggacagctcctctgatcacgccgtc

SEQ ID NO: 30038 - RNA, 33 nt, synthetic construct
  misc_feature 1..33: note = derived and/or modified sequence opt3 from anti-influenza_CDR
  source 1..33: mol_type = other RNA
gccacctgggacgataacctgagcggccccgtg

SEQ ID NO: 30039 - RNA, 33 nt, synthetic construct
  misc_feature 1..33: note = derived and/or modified sequence opt3 from anti-influenza_CDR
  source 1..33: mol_type = other RNA
agctccggctactatcccgcctacctgcctcac

SEQ ID NO: 30040 - RNA, 33 nt, synthetic construct
  misc_feature 1..33: note = derived and/or modified sequence opt3 from anti-influenza_CDR
  source 1..33: mol_type = other RNA
ggcgggaacaatatcggaagcaagggtgtgcac

SEQ ID NO: 30041 - RNA, 33 nt, synthetic construct
  misc_feature 1..33: note = derived and/or modified sequence opt3 from anti-influenza_CDR
  source 1..33: mol_type = other RNA
caggtgtgggacagctcctctgatcacgtcgtt

SEQ ID NO: 30042 - RNA, 33 nt, synthetic construct
  misc_feature 1..33: note = derived and/or modified sequence opt3 from anti-influenza_CDR
  source 1..33: mol_type = other RNA
ggcaactactattacgagagctccctggactat

SEQ ID NO: 30043 - RNA, 33 nt, synthetic construct
  misc_feature 1..33: note = derived and/or modified sequence opt3 from anti-influenza_CDR
  source 1..33: mol_type = other RNA
ggcccccactactatagctcctacatggacgtg

SEQ ID NO: 30044 - RNA, 33 nt, synthetic construct
  misc_feature 1..33: note = derived and/or modified sequence opt3 from anti-influenza_CDR
  source 1..33: mol_type = other RNA
agagccagccagggcatctccacctacctggct

SEQ ID NO: 30045 - RNA, 33 nt, synthetic construct
  misc_feature 1..33: note = derived and/or modified sequence opt3 from anti-influenza_CDR
  source 1..33: mol_type = other RNA
ggccccacctactattacagctatatggacgtg

SEQ ID NO: 30046 - RNA, 33 nt, synthetic construct
  misc_feature 1..33: note = derived and/or modified sequence opt3 from anti-influenza_CDR
  source 1..33: mol_type = other RNA
ggcgggaacaatatcggaagaaacagcgtgcac

SEQ ID NO: 30047 - RNA, 33 nt, synthetic construct
  misc_feature 1..33: note = derived and/or modified sequence opt3 from anti-influenza_CDR
  source 1..33: mol_type = other RNA
caggtgtggcacagctcctctgaccattacgtc

SEQ ID NO: 30048 - RNA, 33 nt, synthetic construct
  misc_feature 1..33: note = derived and/or modified sequence opt3 from anti-influenza_CDR
  source 1..33: mol_type = other RNA
agctccggctactatccccagtacttccaagac

SEQ ID NO: 30049 - RNA, 33 nt, synthetic construct
  misc_feature 1..33: note = derived and/or modified sequence opt3 from anti-influenza_CDR
  source 1..33: mol_type = other RNA
agagccagccagtccgtgtctaggtacctggct

SEQ ID NO: 30050 - RNA, 33 nt, synthetic construct
  misc_feature 1..33: note = derived and/or modified sequence opt3 from anti-influenza_CDR
  source 1..33: mol_type = other RNA
tggggccaggggaccacactgactgtgagctcc

SEQ ID NO: 30051 - RNA, 33 nt, synthetic construct
  misc_feature 1..33: note = derived and/or modified sequence opt3 from anti-influenza_CDR
  source 1..33: mol_type = other RNA
agagccagccagtccgtggactctaacctggct

SEQ ID NO: 30052 - RNA, 33 nt, synthetic construct
  misc_feature 1..33: note = derived and/or modified sequence opt3 from anti-influenza_CDR
  source 1..33: mol_type = other RNA
agagccagccagtccgtgtctcacaacctggct

SEQ ID NO: 30053 - RNA, 33 nt, synthetic construct
  misc_feature 1..33: note = derived and/or modified sequence opt3 from anti-influenza_CDR
  source 1..33: mol_type = other RNA
agagccagccagtccgtgtcttcaaacctggct

SEQ ID NO: 30054 - RNA, 33 nt, synthetic construct
  misc_feature 1..33: note = derived and/or modified sequence opt3 from anti-influenza_CDR
  source 1..33: mol_type = other RNA
agagccagccagtccgtggaccacaacctggct

SEQ ID NO: 30055 - RNA, 33 nt, synthetic construct
  misc_feature 1..33: note = derived and/or modified sequence opt3 from anti-influenza_CDR
  source 1..33: mol_type = other RNA
cagcactacaccaactggccccctagactgaca

SEQ ID NO: 30056 - RNA, 33 nt, synthetic construct
  misc_feature 1..33: note = derived and/or modified sequence opt3 from anti-influenza_CDR
  source 1..33: mol_type = other RNA
cagcactacaccaactatccccctagactgaca

SEQ ID NO: 30057 - RNA, 33 nt, synthetic construct
  misc_feature 1..33: note = derived and/or modified sequence opt3 from anti-influenza_CDR
  source 1..33: mol_type = other RNA
cagcactacaccaacttccctcccagactgaca

SEQ ID NO: 30058 - RNA, 33 nt, synthetic construct
  misc_feature 1..33: note = derived and/or modified sequence opt3 from anti-influenza_CDR
  source 1..33: mol_type = other RNA
agagccagccaggtgatctcccacaacctggct

SEQ ID NO: 30059 - RNA, 33 nt, synthetic construct
  misc_feature 1..33: note = derived and/or modified sequence opt3 from anti-influenza_CDR
  source 1..33: mol_type = other RNA
cagcactacagcaactggccccctagactgacc

SEQ ID NO: 30060 - RNA, 33 nt, synthetic construct
  misc_feature 1..33: note = derived and/or modified sequence opt3 from anti-influenza_CDR
  source 1..33: mol_type = other RNA
cagcactacagcaacttccctcccagactgacc

SEQ ID NO: 30061 - RNA, 33 nt, synthetic construct
  misc_feature 1..33: note = derived and/or modified sequence opt3 from anti-influenza_CDR
  source 1..33: mol_type = other RNA
cagcactacagcaactatccccctagactgacc

SEQ ID NO: 30062 - RNA, 33 nt, synthetic construct
  misc_feature 1..33: note = derived and/or modified sequence opt3 from anti-influenza_CDR
  source 1..33: mol_type = other RNA
agagccagccagtccgtggctaacaatctggca

SEQ ID NO: 30063 - RNA, 33 nt, synthetic construct
  misc_feature 1..33: note = derived and/or modified sequence opt3 from anti-influenza_CDR
  source 1..33: mol_type = other RNA
cagcaatacaacaattggccccctatgtatacc

SEQ ID NO: 30064 - RNA, 33 nt, synthetic construct
  misc_feature 1..33: note = derived and/or modified sequence opt3 from anti-influenza_CDR
  source 1..33: mol_type = other RNA
agagccagccagtccatcggcaactggctggct

SEQ ID NO: 30065 - RNA, 33 nt, synthetic construct
  misc_feature 1..33: note = derived and/or modified sequence opt3 from anti-influenza_CDR
  source 1..33: mol_type = other RNA
cagagatacaccagcaactcccaaggcttcaca

SEQ ID NO: 30066 - RNA, 33 nt, synthetic construct
  misc_feature 1..33: note = derived and/or modified sequence opt3 from anti-influenza_CDR
  source 1..33: mol_type = other RNA
gccgcttgggacgataccctgaacggccccgtg

SEQ ID NO: 30067 - RNA, 33 nt, synthetic construct
  misc_feature 1..33: note = derived and/or modified sequence opt3 from anti-influenza_CDR
  source 1..33: mol_type = other RNA
aaggccagccagaacgtgggctccaatgtcgct

SEQ ID NO: 30068 - RNA, 33 nt, synthetic construct
  misc_feature 1..33: note = derived and/or modified sequence opt3 from anti-influenza_CDR
  source 1..33: mol_type = other RNA
caggtgtgggacatgagctccgatagaagggtc

SEQ ID NO: 30069 - RNA, 33 nt, synthetic construct
  misc_feature 1..33: note = derived and/or modified sequence opt3 from anti-influenza_CDR
  source 1..33: mol_type = other RNA
cagagcctgctccactccaacggctacaattat

SEQ ID NO: 30070 - RNA, 33 nt, synthetic construct; identical to SEQ ID NO: 14786
  misc_feature 1..33: note = derived and/or modified sequence opt3 from anti-influenza_CDR
  source 1..33: mol_type = other RNA

SEQ ID NO: 30071 - RNA, 33 nt, synthetic construct; identical to SEQ ID NO: 28982
  misc_feature 1..33: note = derived and/or modified sequence opt3 from anti-influenza_CDR
  source 1..33: mol_type = other RNA

SEQ ID NO: 30072 - RNA, 33 nt, synthetic construct
  misc_feature 1..33: note = derived and/or modified sequence opt3 from anti-influenza_CDR
  source 1..33: mol_type = other RNA
cagagcctgctcgactccaacggctacaattat

SEQ ID NO: 30073 - RNA, 33 nt, synthetic construct
  misc_feature 1..33: note = derived and/or modified sequence opt3 from anti-influenza_CDR
  source 1..33: mol_type = other RNA
atgcaggccctgcaaacaccccctatgtacacc

SEQ ID NO: 30074 - RNA, 33 nt, synthetic construct
  misc_feature 1..33: note = derived and/or modified sequence opt3 from anti-influenza_CDR
  source 1..33: mol_type = other RNA
cagagcctgctccactccaacggctacaatcat

SEQ ID NO: 30075 - RNA, 33 nt, synthetic construct
  misc_feature 1..33: note = derived and/or modified sequence opt3 from anti-influenza_CDR
  source 1..33: mol_type = other RNA
caggtgtgggacatcaccagcgatctggtcgtt

SEQ ID NO: 30076 - RNA, 33 nt, synthetic construct
  misc_feature 1..33: note = derived and/or modified sequence opt3 from anti-influenza_CDR
  source 1..33: mol_type = other RNA
agagccagccaggacatctccacctggctggct

SEQ ID NO: 30077 - RNA, 33 nt, synthetic construct
  misc_feature 1..33: note = derived and/or modified sequence opt3 from anti-influenza_CDR
  source 1..33: mol_type = other RNA
agagccagcaggtccatcaccacattcctggct

SEQ ID NO: 30078 - RNA, 33 nt, synthetic construct
  misc_feature 1..33: note = derived and/or modified sequence opt3 from anti-influenza_CDR
  source 1..33: mol_type = other RNA
gggtggggcgccgtgaccagccccttcgacttt

SEQ ID NO: 30079 - RNA, 33 nt, synthetic construct
  misc_feature 1..33: note = derived and/or modified sequence opt3 from anti-influenza_CDR
  source 1..33: mol_type = other RNA
agagccagccagtccgtgtcttcaagttacctg

SEQ ID NO: 30080 - RNA, 36 nt, synthetic construct
  misc_feature 1..36: note = derived and/or modified sequence opt3 from anti-influenza_CDR
  source 1..36: mol_type = other RNA
cagagcgtgctgtactcctctaacaataagaactat

SEQ ID NO: 30081 - RNA, 36 nt, synthetic construct
  misc_feature 1..36: note = derived and/or modified sequence opt3 from anti-influenza_CDR
  source 1..36: mol_type = other RNA
gccgcttgggacgatagcctgtccggctcttgggtg

SEQ ID NO: 30082 - RNA, 36 nt, synthetic construct
  misc_feature 1..36: note = derived and/or modified sequence opt3 from anti-influenza_CDR
  source 1..36: mol_type = other RNA
gtgttctacagcgccgacagaacctcctatgctgat

SEQ ID NO: 30083 - RNA, 36 nt, synthetic construct
  misc_feature 1..36: note = derived and/or modified sequence opt3 from anti-influenza_CDR
  source 1..36: mol_type = other RNA
agagtgggccagagcgtctccgggtctcacctggcc

SEQ ID NO: 30084 - RNA, 36 nt, synthetic construct
  misc_feature 1..36: note = derived and/or modified sequence opt3 from anti-influenza_CDR
  source 1..36: mol_type = other RNA
accctgagctccgcctactctaactataaggtggac

SEQ ID NO: 30085 - RNA, 36 nt, synthetic construct
  misc_feature 1..36: note = derived and/or modified sequence opt3 from anti-influenza_CDR
  source 1..36: mol_type = other RNA
gtgggcaccgggggaatcgtcggtagcaagggcgac

SEQ ID NO: 30086 - RNA, 36 nt, synthetic construct
  misc_feature 1..36: note = derived and/or modified sequence opt3 from anti-influenza_CDR
  source 1..36: mol_type = other RNA
agatacagcaggtcctctcccggcaccttcgagtca

SEQ ID NO: 30087 - RNA, 36 nt, synthetic construct
  misc_feature 1..36: note = derived and/or modified sequence opt3 from anti-influenza_CDR
  source 1..36: mol_type = other RNA
cagagctacgactcctctctgtcaggcttccacgtg

SEQ ID NO: 30088 - RNA, 36 nt, synthetic construct
  misc_feature 1..36: note = derived and/or modified sequence opt3 from anti-influenza_CDR
  source 1..36: mol_type = other RNA
agagccagccagtccgtgtcttcaagtcaactggct

SEQ ID NO: 30089 - RNA, 36 nt, synthetic construct
  misc_feature 1..36: note = derived and/or modified sequence opt3 from anti-influenza_CDR
  source 1..36: mol_type = other RNA
agagccagccagttcgtgtccaccaggtctctggct

SEQ ID NO: 30090 - RNA, 36 nt, synthetic construct
  misc_feature 1..36: note = derived and/or modified sequence opt3 from anti-influenza_CDR
  source 1..36: mol_type = other RNA
gccacctgggacgatagcctgaacggcttctacgtg

SEQ ID NO: 30091 - RNA, 36 nt, synthetic construct
  misc_feature 1..36: note = derived and/or modified sequence opt3 from anti-influenza_CDR
  source 1..36: mol_type = other RNA
agagccagccacttcgtgaactacaggtccctggct

SEQ ID NO: 30092 - RNA, 36 nt, synthetic construct
  misc_feature 1..36: note = derived and/or modified sequence opt3 from anti-influenza_CDR
  source 1..36: mol_type = other RNA
agagccagccacttcgtgatcggcagggctgtcgca

SEQ ID NO: 30093 - RNA, 36 nt, synthetic construct
  misc_feature 1..36: note = derived and/or modified sequence opt3 from anti-influenza_CDR
  source 1..36: mol_type = other RNA
agaatctaccacggcgggaacagcggattcgacttt

SEQ ID NO: 30094 - RNA, 36 nt, synthetic construct; identical to SEQ ID NO: 14810
  misc_feature 1..36: note = derived and/or modified sequence opt3 from anti-influenza_CDR
  source 1..36: mol_type = other RNA

SEQ ID NO: 30095 - RNA, 36 nt, synthetic construct
  misc_feature 1..36: note = derived and/or modified sequence opt3 from anti-influenza_CDR
  source 1..36: mol_type = other RNA
gtgggcaacgggggaaatgtcgccagcaagggtgac

SEQ ID NO: 30096 - RNA, 36 nt, synthetic construct
  misc_feature 1..36: note = derived and/or modified sequence opt3 from anti-influenza_CDR
  source 1..36: mol_type = other RNA
gtgagaggcgggagcaccgtcgcctacttcggagtt

SEQ ID NO: 30097 - RNA, 36 nt, synthetic construct
  misc_feature 1..36: note = derived and/or modified sequence opt3 from anti-influenza_CDR
  source 1..36: mol_type = other RNA
tgcctgagcagaatgaggggctacgggctcgacgtg

SEQ ID NO: 30098 - RNA, 36 nt, synthetic construct
  misc_feature 1..36: note = derived and/or modified sequence opt3 from anti-influenza_CDR
  source 1..36: mol_type = other RNA
gtgggccagatggacaagtactatgccatggatgtc

SEQ ID NO: 30099 - RNA, 36 nt, synthetic construct
  misc_feature 1..36: note = derived and/or modified sequence opt3 from anti-influenza_CDR
  source 1..36: mol_type = other RNA
ggcgtgaccaacaaggtcaatagcatcattgacaaa

SEQ ID NO: 30100 - RNA, 36 nt, synthetic construct
  misc_feature 1..36: note = derived and/or modified sequence opt3 from anti-influenza_CDR
  source 1..36: mol_type = other RNA
ggcgtgaccaacaaggtcaatagaatcattgacaaa

SEQ ID NO: 30101 - RNA, 36 nt, synthetic construct
  misc_feature 1..36: note = derived and/or modified sequence opt3 from anti-influenza_CDR
  source 1..36: mol_type = other RNA
ggcgtgaccaacaaggagaatagcatcattgacaaa

SEQ ID NO: 30102 - RNA, 36 nt, synthetic construct
  misc_feature 1..36: note = derived and/or modified sequence opt3 from anti-influenza_CDR
  source 1..36: mol_type = other RNA
cccctgggcatcctccactactatgccatggacctt

SEQ ID NO: 30103 - RNA, 36 nt, synthetic construct
  misc_feature 1..36: note = derived and/or modified sequence opt3 from anti-influenza_CDR
  source 1..36: mol_type = other RNA
aagatcaccagcaaagtgaacaatattgtcgacaag

SEQ ID NO: 30104 - RNA, 36 nt, synthetic construct
  misc_feature 1..36: note = derived and/or modified sequence opt3 from anti-influenza_CDR
  source 1..36: mol_type = other RNA
ggcatcaccaacaaggtgaatagcattatagacaaa

SEQ ID NO: 30105 - RNA, 36 nt, synthetic construct
  misc_feature 1..36: note = derived and/or modified sequence opt3 from anti-influenza_CDR
  source 1..36: mol_type = other RNA
aacggcagaagctccacctcttgggggatcgacgtg

SEQ ID NO: 30106 - RNA, 36 nt, synthetic construct
  misc_feature 1..36: note = derived and/or modified sequence opt3 from anti-influenza_CDR
  source 1..36: mol_type = other RNA
ggcatcaccaacaaggagaatagcgtgattgaaaaa

SEQ ID NO: 30107 - RNA, 36 nt, synthetic construct
  misc_feature 1..36: note = derived and/or modified sequence opt3 from anti-influenza_CDR
  source 1..36: mol_type = other RNA
cccctgggcagcagatactattacgggatggacgtg

SEQ ID NO: 30108 - RNA, 36 nt, synthetic construct
  misc_feature 1..36: note = derived and/or modified sequence opt3 from anti-influenza_CDR
  source 1..36: mol_type = other RNA
ggcatcaccaacaaggtgaatagcgtcattgagaaa

SEQ ID NO: 30109 - RNA, 36 nt, synthetic construct
  misc_feature 1..36: note = derived and/or modified sequence opt3 from anti-influenza_CDR
  source 1..36: mol_type = other RNA
ggcgtgaccaacaaggtcaatagcatcattaacaaa

SEQ ID NO: 30110 - RNA, 36 nt, synthetic construct
  misc_feature 1..36: note = derived and/or modified sequence opt3 from anti-influenza_CDR
  source 1..36: mol_type = other RNA
cacatgggctaccaggtgagagagaccatggacgtc

SEQ ID NO: 30111 - RNA, 36 nt, synthetic construct
  misc_feature 1..36: note = derived and/or modified sequence opt3 from anti-influenza_CDR
  source 1..36: mol_type = other RNA
gccacctgggacagaaggcccacagcttacgtggtc

SEQ ID NO: 30112 - RNA, 36 nt, synthetic construct
  misc_feature 1..36: note = derived and/or modified sequence opt3 from anti-influenza_CDR
  source 1..36: mol_type = other RNA
gagggcaagtgggggccccaggccgctttcgacatc

SEQ ID NO: 30113 - RNA, 36 nt, synthetic construct
  misc_feature 1..36: note = derived and/or modified sequence opt3 from anti-influenza_CDR
  source 1..36: mol_type = other RNA
ggcgacaaggggatctactattactatatggatgtg

SEQ ID NO: 30114 - RNA, 36 nt, synthetic construct; identical to SEQ ID NO: 14830
  misc_feature 1..36: note = derived and/or modified sequence opt3 from anti-influenza_CDR
  source 1..36: mol_type = other RNA

SEQ ID NO: 30115 - RNA, 36 nt, synthetic construct
  misc_feature 1..36: note = derived and/or modified sequence opt3 from anti-influenza_CDR
  source 1..36: mol_type = other RNA
agagccagccagtccgtgtcttcaagttacctggct

SEQ ID NO: 30116 - RNA, 36 nt, synthetic construct
  misc_feature 1..36: note = derived and/or modified sequence opt3 from anti-influenza_CDR
  source 1..36: mol_type = other RNA
ggcagcgggtacaccacaagaaactatttcgactac

SEQ ID NO: 30117 - RNA, 36 nt, synthetic construct
  misc_feature 1..36: note = derived and/or modified sequence opt3 from anti-influenza_CDR
  source 1..36: mol_type = other RNA
agagccagccagtccgtgtcttcaaactacctgggc

SEQ ID NO: 30118 - RNA, 36 nt, synthetic construct
  misc_feature 1..36: note = derived and/or modified sequence opt3 from anti-influenza_CDR
  source 1..36: mol_type = other RNA
ggcagcacctacgacttctcctctgggctggattat

SEQ ID NO: 30119 - RNA, 36 nt, synthetic construct
  misc_feature 1..36: note = derived and/or modified sequence opt3 from anti-influenza_CDR
  source 1..36: mol_type = other RNA
ggcgtgcaccatcccgggaccgacaacgatcagatc

SEQ ID NO: 30120 - RNA, 36 nt, synthetic construct
  misc_feature 1..36: note = derived and/or modified sequence opt3 from anti-influenza_CDR
  source 1..36: mol_type = other RNA
ggcgtgcaccatcccagcaccgactccgatcagaca

SEQ ID NO: 30121 - RNA, 36 nt, synthetic construct
  misc_feature 1..36: note = derived and/or modified sequence opt3 from anti-influenza_CDR
  source 1..36: mol_type = other RNA
ggcgtgcaccatcccagcaacgagaccgaacagaga

SEQ ID NO: 30122 - RNA, 36 nt, synthetic construct
  misc_feature 1..36: note = derived and/or modified sequence opt3 from anti-influenza_CDR
  source 1..36: mol_type = other RNA
cagagcatcaccttcgactacaagaactatctggcc

SEQ ID NO: 30123 - RNA, 36 nt, synthetic construct
  misc_feature 1..36: note = derived and/or modified sequence opt3 from anti-influenza_CDR
  source 1..36: mol_type = other RNA
ggcgggctgatcggaaccggtagctactattggggc

SEQ ID NO: 30124 - RNA, 36 nt, synthetic construct
  misc_feature 1..36: note = derived and/or modified sequence opt3 from anti-influenza_CDR
  source 1..36: mol_type = other RNA
gccagatacaactggggcatcaggtatttcgacttt

SEQ ID NO: 30125 - RNA, 36 nt, synthetic construct
  misc_feature 1..36: note = derived and/or modified sequence opt3 from anti-influenza_CDR
  source 1..36: mol_type = other RNA
cagagcgtgctgtccaactctaagaatctcaactac

SEQ ID NO: 30126 - RNA, 36 nt, synthetic construct
  misc_feature 1..36: note = derived and/or modified sequence opt3 from anti-influenza_CDR
  source 1..36: mol_type = other RNA
tgccaggtgtgggagaccagcgaagacctgtgggtc

SEQ ID NO: 30127 - RNA, 39 nt, synthetic construct
  misc_feature 1..39: note = derived and/or modified sequence opt3 from anti-influenza_CDR
  source 1..39: mol_type = other RNA
gccagaggcgggaggtactatgtggactacttcgattat

SEQ ID NO: 30128 - RNA, 39 nt, synthetic construct
  misc_feature 1..39: note = derived and/or modified sequence opt3 from anti-influenza_CDR
  source 1..39: mol_type = other RNA
gccagaagcggcgacgggtacaactattacttccccctg

SEQ ID NO: 30129 - RNA, 39 nt, synthetic construct
  misc_feature 1..39: note = derived and/or modified sequence opt3 from anti-influenza_CDR
  source 1..39: mol_type = other RNA
gccagaggctgcgggtacaactgttattacttcgacgga

SEQ ID NO: 30130 - RNA, 39 nt, synthetic construct
  misc_feature 1..39: note = derived and/or modified sequence opt3 from anti-influenza_CDR
  source 1..39: mol_type = other RNA
agcggctcctcttcaaacatcgggagtaataccgtgaac

SEQ ID NO: 30131 - RNA, 39 nt, synthetic construct
  misc_feature 1..39: note = derived and/or modified sequence opt3 from anti-influenza_CDR
  source 1..39: mol_type = other RNA
gacagcccctactcctcttcatggagtttctttgattat

SEQ ID NO: 30132 - RNA, 39 nt, synthetic construct
  misc_feature 1..39: note = derived and/or modified sequence opt3 from anti-influenza_CDR
  source 1..39: mol_type = other RNA
agcggctccgactctaacatcggggattacttcgtgtgc

SEQ ID NO: 30133 - RNA, 39 nt, synthetic construct
  misc_feature 1..39: note = derived and/or modified sequence opt3 from anti-influenza_CDR
  source 1..39: mol_type = other RNA
gccagaatggtggtcgttaccggcgacgggttcgatgtg

SEQ ID NO: 30134 - RNA, 39 nt, synthetic construct
  misc_feature 1..39: note = derived and/or modified sequence opt3 from anti-influenza_CDR
  source 1..39: mol_type = other RNA
tggctgagcatcattaacgccggcgggggagacatagat

SEQ ID NO: 30135 - RNA, 39 nt, synthetic construct
  misc_feature 1..39: note = derived and/or modified sequence opt3 from anti-influenza_CDR
  source 1..39: mol_type = other RNA
gccgctagctccctgcagtctggcgtgccctcaagattc

SEQ ID NO: 30136 - RNA, 39 nt, synthetic construct
  misc_feature 1..39: note = derived and/or modified sequence opt3 from anti-influenza_CDR
  source 1..39: mol_type = other RNA
cacgacgccaagttcagcggctcctactatgtggcttct

SEQ ID NO: 30137 - RNA, 39 nt, synthetic construct
  misc_feature 1..39: note = derived and/or modified sequence opt3 from anti-influenza_CDR
  source 1..39: mol_type = other RNA
cacgacgtgaagttcagcggctcctactatgtcgcctct

SEQ ID NO: 30138 - RNA, 39 nt, synthetic construct
  misc_feature 1..39: note = derived and/or modified sequence opt3 from anti-influenza_CDR
  source 1..39: mol_type = other RNA
accggcagcgagtccacaactgggtacggaatggacgtg

SEQ ID NO: 30139 - RNA, 39 nt, synthetic construct
  misc_feature 1..39: note = derived and/or modified sequence opt3 from anti-influenza_CDR
  source 1..39: mol_type = other RNA
gccgctagcacctccgtgctgggctacgggatggacgtc

SEQ ID NO: 30140 - RNA, 39 nt, synthetic construct
  misc_feature 1..39: note = derived and/or modified sequence opt3 from anti-influenza_CDR
  source 1..39: mol_type = other RNA
agcggctccaccttcaacatcgggtctaatgccgtggac

SEQ ID NO: 30141 - RNA, 39 nt, synthetic construct
  misc_feature 1..39: note = derived and/or modified sequence opt3 from anti-influenza_CDR
  source 1..39: mol_type = other RNA
agcggctccagatctaacgtgggggacaattcagtctac

SEQ ID NO: 30142 - RNA, 39 nt, synthetic construct
  misc_feature 1..39: note = derived and/or modified sequence opt3 from anti-influenza_CDR
  source 1..39: mol_type = other RNA
agcggctcctcttcaaacatcgggaatgactacgtgagt

SEQ ID NO: 30143 - RNA, 39 nt, synthetic construct
  misc_feature 1..39: note = derived and/or modified sequence opt3 from anti-influenza_CDR
  source 1..39: mol_type = other RNA
ggcgggggaagctacggtgcctatgagggcttcgactac

SEQ ID NO: 30144 - RNA, 39 nt, synthetic construct
  misc_feature 1..39: note = derived and/or modified sequence opt3 from anti-influenza_CDR
  source 1..39: mol_type = other RNA
agcggctcctcttcaaacatcgggagtaattacgtgtat

SEQ ID NO: 30145 - RNA, 39 nt, synthetic construct
  misc_feature 1..39: note = derived and/or modified sequence opt3 from anti-influenza_CDR
  source 1..39: mol_type = other RNA
gccagaaggcagcaactgtacaagggctattaccaccat

SEQ ID NO: 30146 - RNA, 39 nt, synthetic construct
  misc_feature 1..39: note = derived and/or modified sequence opt3 from anti-influenza_CDR
  source 1..39: mol_type = other RNA
agcggctccacctctaacatcgggtacaatcccgtgtca

SEQ ID NO: 30147 - RNA, 39 nt, synthetic construct
  misc_feature 1..39: note = derived and/or modified sequence opt3 from anti-influenza_CDR
  source 1..39: mol_type = other RNA
gccagaggcatgaactactatagcgactacttcgattat

SEQ ID NO: 30148 - RNA, 39 nt, synthetic construct
  misc_feature 1..39: note = derived and/or modified sequence opt3 from anti-influenza_CDR
  source 1..39: mol_type = other RNA
gccagaggccacagcgggtcctacaggctgttcgacttt

SEQ ID NO: 30149 - RNA, 39 nt, synthetic construct
  misc_feature 1..39: note = derived and/or modified sequence opt3 from anti-influenza_CDR
  source 1..39: mol_type = other RNA
gccaagcccctgagaggcagctacaggtatttcgacctc

SEQ ID NO: 30150 - RNA, 39 nt, synthetic construct
  misc_feature 1..39: note = derived and/or modified sequence opt3 from anti-influenza_CDR
  source 1..39: mol_type = other RNA
cccatctgggtgaagacccctctgaaactcgccaacggc

SEQ ID NO: 30151 - RNA, 39 nt, synthetic construct
  misc_feature 1..39: note = derived and/or modified sequence opt3 from anti-influenza_CDR
  source 1..39: mol_type = other RNA
caggccagccaatccgtgtacaacaagaataacctggct

SEQ ID NO: 30152 - RNA, 39 nt, synthetic construct
  misc_feature 1..39: note = derived and/or modified sequence opt3 from anti-influenza_CDR
  source 1..39: mol_type = other RNA
cagagctccgagtctgtgtacaagaacaataacctggcc

SEQ ID NO: 30153 - RNA, 39 nt, synthetic construct
  misc_feature 1..39: note = derived and/or modified sequence opt3 from anti-influenza_CDR
  source 1..39: mol_type = other RNA
cagagctcccaatctgtggactcaaacaatcagctgagt

SEQ ID NO: 30154 - RNA, 39 nt, synthetic construct
  misc_feature 1..39: note = derived and/or modified sequence opt3 from anti-influenza_CDR
  source 1..39: mol_type = other RNA
cagagctcccaatctgtggacaacaataaggatctggcc

SEQ ID NO: 30155 - RNA, 39 nt, synthetic construct
  misc_feature 1..39: note = derived and/or modified sequence opt3 from anti-influenza_CDR
  source 1..39: mol_type = other RNA
cagagctcccaatctgtgtacaacaataacagactgtca

SEQ ID NO: 30156 - RNA, 39 nt, synthetic construct
  misc_feature 1..39: note = derived and/or modified sequence opt3 from anti-influenza_CDR
  source 1..39: mol_type = other RNA
cagagctcccaatctgtgtacaagaacaataacctggcc

SEQ ID NO: 30157 - RNA, 39 nt, synthetic construct
  misc_feature 1..39: note = derived and/or modified sequence opt3 from anti-influenza_CDR
  source 1..39: mol_type = other RNA
ggcgggggattcggttggagccagacctactttggctat

SEQ ID NO: 30158 - RNA, 42 nt, synthetic construct
  misc_feature 1..42: note = derived and/or modified sequence opt3 from anti-influenza_CDR
  source 1..42: mol_type = other RNA
tggctgggcagaacctactataggagcaagtggtacaacgac

SEQ ID NO: 30159 - RNA, 42 nt, synthetic construct
  misc_feature 1..42: note = derived and/or modified sequence opt3 from anti-influenza_CDR
  source 1..42: mol_type = other RNA
ggcgggctggtgggaggttacgacgagtatttctttgattac

SEQ ID NO: 30160 - RNA, 42 nt, synthetic construct
  misc_feature 1..42: note = derived and/or modified sequence opt3 from anti-influenza_CDR
  source 1..42: mol_type = other RNA
caccccaagtacttctatggcagcgggtcctaccctgacttt

SEQ ID NO: 30161 - RNA, 42 nt, synthetic construct
  misc_feature 1..42: note = derived and/or modified sequence opt3 from anti-influenza_CDR
  source 1..42: mol_type = other RNA
accggcagctcctctgacgtgggggcctcaaacagtgtcagc

SEQ ID NO: 30162 - RNA, 42 nt, synthetic construct
  misc_feature 1..42: note = derived and/or modified sequence opt3 from anti-influenza_CDR
  source 1..42: mol_type = other RNA
ggcgcctactatgacagctccgggtaccccgctttctatatc

SEQ ID NO: 30163 - RNA, 42 nt, synthetic construct
  misc_feature 1..42: note = derived and/or modified sequence opt3 from anti-influenza_CDR
  source 1..42: mol_type = other RNA
accggcagctcctctaacatcgggtcagactacgatgtgcac

SEQ ID NO: 30164 - RNA, 42 nt, synthetic construct
  misc_feature 1..42: note = derived and/or modified sequence opt3 from anti-influenza_CDR
  source 1..42: mol_type = other RNA
gagttcgaaaccagcggctactttcacgggtccttcgactat

SEQ ID NO: 30165 - RNA, 42 nt, synthetic construct
  misc_feature 1..42: note = derived and/or modified sequence opt3 from anti-influenza_CDR
  source 1..42: mol_type = other RNA
gccagctccaccggcgctgtgacatcttcatacttccccaac

SEQ ID NO: 30166 - RNA, 42 nt, synthetic construct
  misc_feature 1..42: note = derived and/or modified sequence opt3 from anti-influenza_CDR
  source 1..42: mol_type = other RNA
accggcgggagctccgacatcggagcctctaactcagtgagt

SEQ ID NO: 30167 - RNA, 42 nt, synthetic construct
  misc_feature 1..42: note = derived and/or modified sequence opt3 from anti-influenza_CDR
  source 1..42: mol_type = other RNA
accggcagctcctctgacgtcgggggatacgattatgtgtca

SEQ ID NO: 30168 - RNA, 42 nt, synthetic construct
  misc_feature 1..42: note = derived and/or modified sequence opt3 from anti-influenza_CDR
  source 1..42: mol_type = other RNA
ggcagctccaccggggccgtgacaagaggacactacccctat

SEQ ID NO: 30169 - RNA, 42 nt, synthetic construct
  misc_feature 1..42: note = derived and/or modified sequence opt3 from anti-influenza_CDR
  source 1..42: mol_type = other RNA
ggcagctccaccgggcccgtgacatctggacactacccttat

SEQ ID NO: 30170 - RNA, 42 nt, synthetic construct
  misc_feature 1..42: note = derived and/or modified sequence opt3 from anti-influenza_CDR
  source 1..42: mol_type = other RNA
cactacggcgacagcgaggccatcaacgatgctttcgacatt

SEQ ID NO: 30171 - RNA, 42 nt, synthetic construct
  misc_feature 1..42: note = derived and/or modified sequence opt3 from anti-influenza_CDR
  source 1..42: mol_type = other RNA
accggcagctcctctaacatcggggccggatacgacgtgcac

SEQ ID NO: 30172 - RNA, 42 nt, synthetic construct
  misc_feature 1..42: note = derived and/or modified sequence opt3 from anti-influenza_CDR
  source 1..42: mol_type = other RNA
atcccccactacaacttcggcagcgggtcctattttgactac

SEQ ID NO: 30173 - RNA, 42 nt, synthetic construct
  misc_feature 1..42: note = derived and/or modified sequence opt3 from anti-influenza_CDR
  source 1..42: mol_type = other RNA
accggcacaagctccgacgtcgggggatacaactatgtgtct

SEQ ID NO: 30174 - RNA, 42 nt, synthetic construct
  misc_feature 1..42: note = derived and/or modified sequence opt3 from anti-influenza_CDR
  source 1..42: mol_type = other RNA
accggcacaagctccgacgtgggggcctacaactatgtctct

SEQ ID NO: 30175 - RNA, 42 nt, synthetic construct
  misc_feature 1..42: note = derived and/or modified sequence opt3 from anti-influenza_CDR
  source 1..42: mol_type = other RNA
gccgagagacccaaggtgaggggccaggctgggcggatgaac

SEQ ID NO: 30176 - RNA, 42 nt, synthetic construct
  misc_feature 1..42: note = derived and/or modified sequence opt3 from anti-influenza_CDR
  source 1..42: mol_type = other RNA
gggagcagaccctgggtgaggggcgtctcctctcggatctca

SEQ ID NO: 30177 - RNA, 42 nt, synthetic construct
  misc_feature 1..42: note = derived and/or modified sequence opt3 from anti-influenza_CDR
  source 1..42: mol_type = other RNA
atctggggcgtggccgctcccgggaccgcagccgcgcagatt

SEQ ID NO: 30178 - RNA, 42 nt, synthetic construct
  misc_feature 1..42: note = derived and/or modified sequence opt3 from anti-influenza_CDR
  source 1..42: mol_type = other RNA
tgggtgagacagccccctggcaaggggctggagtgggtcgcc

SEQ ID NO: 30179 - RNA, 42 nt, synthetic construct
  misc_feature 1..42: note = derived and/or modified sequence opt3 from anti-influenza_CDR
  source 1..42: mol_type = other RNA
gccagaggccccgagggggtgtggggaaggagcatcgactcc

SEQ ID NO: 30180 - RNA, 42 nt, synthetic construct
  misc_feature 1..42: note = derived and/or modified sequence opt3 from anti-influenza_CDR
  source 1..42: mol_type = other RNA
gccagagaccccgatacccctttcgtgagggcttttgacagc

SEQ ID NO: 30181 - RNA, 42 nt, synthetic construct
  misc_feature 1..42: note = derived and/or modified sequence opt3 from anti-influenza_CDR
  source 1..42: mol_type = other RNA
accggcagcacatccgacatcgggtcttacaactatgtgtca

SEQ ID NO: 30182 - RNA, 42 nt, synthetic construct
  misc_feature 1..42: note = derived and/or modified sequence opt3 from anti-influenza_CDR
  source 1..42: mol_type = other RNA
tgggactggaacttcgatctgtacctcggctggtttgacccc

SEQ ID NO: 30183 - RNA, 42 nt, synthetic construct
  misc_feature 1..42: note = derived and/or modified sequence opt3 from anti-influenza_CDR
  source 1..42: mol_type = other RNA
tgggcctggaacttcgactttttcctgggctggtttgatccc

SEQ ID NO: 30184 - RNA, 42 nt, synthetic construct
  misc_feature 1..42: note = derived and/or modified sequence opt3 from anti-influenza_CDR
  source 1..42: mol_type = other RNA
ggccccgggtacagcggatatcactacggttggttcgacacc

SEQ ID NO: 30185 - RNA, 42 nt, synthetic construct
  misc_feature 1..42: note = derived and/or modified sequence opt3 from anti-influenza_CDR
  source 1..42: mol_type = other RNA
gccagatgggactacggcgtgtatgaggggtacatcgattat

SEQ ID NO: 30186 - RNA, 45 nt, synthetic construct
  misc_feature 1..45: note = derived and/or modified sequence opt3 from anti-influenza_CDR
  source 1..45: mol_type = other RNA
gccagagctggcaccacactgactaggttcaactggtttgacccc

SEQ ID NO: 30187 - RNA, 45 nt, synthetic construct
  misc_feature 1..45: note = derived and/or modified sequence opt3 from anti-influenza_CDR
  source 1..45: mol_type = other RNA
gccagagctggcaccacagtgactaggttcaactggtttgacccc

SEQ ID NO: 30188 - RNA, 45 nt, synthetic construct
  misc_feature 1..45: note = derived and/or modified sequence opt3 from anti-influenza_CDR
  source 1..45: mol_type = other RNA
gccagaggccagaggtactattacgaccgggatgggatggacgtg

SEQ ID NO: 30189 - RNA, 45 nt, synthetic construct
  misc_feature 1..45: note = derived and/or modified sequence opt3 from anti-influenza_CDR
  source 1..45: mol_type = other RNA
gccagaagcggcgggtacctgccccagaacaattggatcgaccct

SEQ ID NO: 30190 - RNA, 45 nt, synthetic construct
  misc_feature 1..45: note = derived and/or modified sequence opt3 from anti-influenza_CDR
  source 1..45: mol_type = other RNA
atggagaacgaaagaaccctggacttccacgatagcaatgtgaag

SEQ ID NO: 30191 - RNA, 45 nt, synthetic construct
  misc_feature 1..45: note = derived and/or modified sequence opt3 from anti-influenza_CDR
  source 1..45: mol_type = other RNA
ggcgccgaccacgggagcggatccaacttcgtgtctccctacgtc

SEQ ID NO: 30192 - RNA, 45 nt, synthetic construct
  misc_feature 1..45: note = derived and/or modified sequence opt3 from anti-influenza_CDR
  source 1..45: mol_type = other RNA
gacaccagaagctccctggataactaccagtatggcatggacgtg

SEQ ID NO: 30193 - RNA, 45 nt, synthetic construct
  misc_feature 1..45: note = derived and/or modified sequence opt3 from anti-influenza_CDR
  source 1..45: mol_type = other RNA
gaggactacgatatcctgaccggcgccgggcccggaatggaagtg

SEQ ID NO: 30194 - RNA, 45 nt, synthetic construct
  misc_feature 1..45: note = derived and/or modified sequence opt3 from anti-influenza_CDR
  source 1..45: mol_type = other RNA
cacccctacgacgtgctgaccggcagcggggattggttcgaccct

SEQ ID NO: 30195 - RNA, 45 nt, synthetic construct
  misc_feature 1..45: note = derived and/or modified sequence opt3 from anti-influenza_CDR
  source 1..45: mol_type = other RNA
ggcgccgaccacgggagcggaaacaatttcgtgtccccctacgtc

SEQ ID NO: 30196 - RNA, 45 nt, synthetic construct
  misc_feature 1..45: note = derived and/or modified sequence opt3 from anti-influenza_CDR
  source 1..45: mol_type = other RNA
gtgatctacagcggcgggtccacctattacgccgactctgtcaag

SEQ ID NO: 30197 - RNA, 45 nt, synthetic construct
  misc_feature 1..45: note = derived and/or modified sequence opt3 from anti-influenza_CDR
  source 1..45: mol_type = other RNA
tggtaccagcaaaagcccggcaaagcccctaagctgctcatctat

SEQ ID NO: 30198 - RNA, 45 nt, synthetic construct
  misc_feature 1..45: note = derived and/or modified sequence opt3 from anti-influenza_CDR
  source 1..45: mol_type = other RNA
gacccctacaacgatggcaccaagtataatgagaaattcgaaggg

SEQ ID NO: 30199 - RNA, 45 nt, synthetic construct
  misc_feature 1..45: note = derived and/or modified sequence opt3 from anti-influenza_CDR
  source 1..45: mol_type = other RNA
gccagagctcacaccgcactgacaaggttccggtggctcgacccc

SEQ ID NO: 30200 - RNA, 45 nt, synthetic construct
  misc_feature 1..45: note = derived and/or modified sequence opt3 from anti-influenza_CDR
  source 1..45: mol_type = other RNA
gccagcctggactacgatttctcctattactatcacagagacgtg

SEQ ID NO: 30201 - RNA, 45 nt, synthetic construct
  misc_feature 1..45: note = derived and/or modified sequence opt3 from anti-influenza_CDR
  source 1..45: mol_type = other RNA
gccagagtggctaccccctactattacgagagcggcttcgactat

SEQ ID NO: 30202 - RNA, 45 nt, synthetic construct
  misc_feature 1..45: note = derived and/or modified sequence opt3 from anti-influenza_CDR
  source 1..45: mol_type = other RNA
gccagaaggggcgggggatggcagtactattacggtatggacgtg

SEQ ID NO: 30203 - RNA, 48 nt, synthetic construct
  misc_feature 1..48: note = derived and/or modified sequence opt3 from anti-influenza_CDR
  source 1..48: mol_type = other RNA
agcggccacatcaccgtgttcggggtcaacgttgacgcctttgatatg

SEQ ID NO: 30204 - RNA, 48 nt, synthetic construct
  misc_feature 1..48: note = derived and/or modified sequence opt3 from anti-influenza_CDR
  source 1..48: mol_type = other RNA
ggcgggcacatcaccgtgttcggactgaacattgacgcctacgatata

SEQ ID NO: 30205 - RNA, 48 nt, synthetic construct
  misc_feature 1..48: note = derived and/or modified sequence opt3 from anti-influenza_CDR
  source 1..48: mol_type = other RNA
ggcgggcacatcaccgagttcggactgaacattgacgcctacgatata

SEQ ID NO: 30206 - RNA, 48 nt, synthetic construct
  misc_feature 1..48: note = derived and/or modified sequence opt3 from anti-influenza_CDR
  source 1..48: mol_type = other RNA
ggcgggcacatcaccgtgttcggagtcaacattgacgcctttgatata

SEQ ID NO: 30207 - RNA, 48 nt, synthetic construct
  misc_feature 1..48: note = derived and/or modified sequence opt3 from anti-influenza_CDR
  source 1..48: mol_type = other RNA
ggcgggcacatcaccgtgttcggagtcaacattgacgcctttgatgtt

SEQ ID NO: 30208 - RNA, 48 nt, synthetic construct
  misc_feature 1..48: note = derived and/or modified sequence opt3 from anti-influenza_CDR
  source 1..48: mol_type = other RNA
gccagagacggctgggggcagcaactggtgccctactatttcgattac

SEQ ID NO: 30209 - RNA, 48 nt, synthetic construct
  misc_feature 1..48: note = derived and/or modified sequence opt3 from anti-influenza_CDR
  source 1..48: mol_type = other RNA
gacttctgggtgagctactattacgattcctctgctccccctgccatc

SEQ ID NO: 30210 - RNA, 48 nt, synthetic construct
  misc_feature 1..48: note = derived and/or modified sequence opt3 from anti-influenza_CDR
  source 1..48: mol_type = other RNA
gccagagctggcgtgaagatcttcgggctgattgtcggagcactcgac

SEQ ID NO: 30211 - RNA, 48 nt, synthetic construct
  misc_feature 1..48: note = derived and/or modified sequence opt3 from anti-influenza_CDR
  source 1..48: mol_type = other RNA
gccagagacggcgctgggagctactatcccctgaactggttcgatcct

SEQ ID NO: 30212 - RNA, 48 nt, synthetic construct
  misc_feature 1..48: note = derived and/or modified sequence opt3 from anti-influenza_CDR
  source 1..48: mol_type = other RNA
gtgatctacagccacggcagagcctattactccgcttctgtcaacggg

SEQ ID NO: 30213 - RNA, 48 nt, synthetic construct
  misc_feature 1..48: note = derived and/or modified sequence opt3 from anti-influenza_CDR
  source 1..48: mol_type = other RNA
gacaccctgcacaacggctacacaaattataaccccagcctcagaggg

SEQ ID NO: 30214 - RNA, 48 nt, synthetic construct
  misc_feature 1..48: note = derived and/or modified sequence opt3 from anti-influenza_CDR
  source 1..48: mol_type = other RNA
tacatcagctataacggcagacccaagtacaatccttccctgacctct

SEQ ID NO: 30215 - RNA, 48 nt, synthetic construct
  misc_feature 1..48: note = derived and/or modified sequence opt3 from anti-influenza_CDR
  source 1..48: mol_type = other RNA
gagaccagattcggcgaactgctcagcccctacgacgcctttgagatc

SEQ ID NO: 30216 - RNA, 48 nt, synthetic construct
  misc_feature 1..48: note = derived and/or modified sequence opt3 from anti-influenza_CDR
  source 1..48: mol_type = other RNA
ctgatctactgggacgatgacaagagatatagcccctccctcaaaagg

SEQ ID NO: 30217 - RNA, 48 nt, synthetic construct
  misc_feature 1..48: note = derived and/or modified sequence opt3 from anti-influenza_CDR
  source 1..48: mol_type = other RNA
tacatctattacattggcaacaccgactatagacccagcctgaagtcc

SEQ ID NO: 30218 - RNA, 48 nt, synthetic construct
  misc_feature 1..48: note = derived and/or modified sequence opt3 from anti-influenza_CDR
  source 1..48: mol_type = other RNA
gagatcagccacggcgggtccaccaactacaatccctctctgaagtca

SEQ ID NO: 30219 - RNA, 48 nt, synthetic construct
  misc_feature 1..48: note = derived and/or modified sequence opt3 from anti-influenza_CDR
  source 1..48: mol_type = other RNA
gagatcaaccacagcggcagaaccaattacaacccctccctgaagtct

SEQ ID NO: 30220 - RNA, 48 nt, synthetic construct
  misc_feature 1..48: note = derived and/or modified sequence opt3 from anti-influenza_CDR
  source 1..48: mol_type = other RNA
ctgatcagctgggacgatgagaagcactactccccctctctccagtca

SEQ ID NO: 30221 - RNA, 48 nt, synthetic construct
  misc_feature 1..48: note = derived and/or modified sequence opt3 from anti-influenza_CDR
  source 1..48: mol_type = other RNA
gagggcgtgtacttcgacagcgggacctatagaggatactttgattat

SEQ ID NO: 30222 - RNA, 48 nt, synthetic construct
  misc_feature 1..48: note = derived and/or modified sequence opt3 from anti-influenza_CDR
  source 1..48: mol_type = other RNA
tacatctatcacagcggctccaccaactacaatccctctctgaagtca

SEQ ID NO: 30223 - RNA, 48 nt, synthetic construct
  misc_feature 1..48: note = derived and/or modified sequence opt3 from anti-influenza_CDR
  source 1..48: mol_type = other RNA
tacatctattacagaggcagcaccttctataacccctccctgaagtct

SEQ ID NO: 30224 - RNA, 48 nt, synthetic construct
  misc_feature 1..48: note = derived and/or modified sequence opt3 from anti-influenza_CDR
  source 1..48: mol_type = other RNA
tacatcagctattccggctctaccaagtacaacccctcactgagaagt

SEQ ID NO: 30225 - RNA, 48 nt, synthetic construct
  misc_feature 1..48: note = derived and/or modified sequence opt3 from anti-influenza_CDR
  source 1..48: mol_type = other RNA
gagatcaagcacagcggcagaaccaactacaatccctccctggaatct

SEQ ID NO: 30226 - RNA, 48 nt, synthetic construct
  misc_feature 1..48: note = derived and/or modified sequence opt3 from anti-influenza_CDR
  source 1..48: mol_type = other RNA
gagatcaaccacagcggcgggaccaattacaacccctccctgaagaga

SEQ ID NO: 30227 - RNA, 48 nt, synthetic construct
  misc_feature 1..48: note = derived and/or modified sequence opt3 from anti-influenza_CDR
  source 1..48: mol_type = other RNA
ttcatgtactatagcgcctccacctactataacccctctctgaagtca

SEQ ID NO: 30228 - RNA, 48 nt, synthetic construct
  misc_feature 1..48: note = derived and/or modified sequence opt3 from anti-influenza_CDR
  source 1..48: mol_type = other RNA
tacgtgtattacagcggctccaccacatataacccctctctgaagtca

SEQ ID NO: 30229 - RNA, 48 nt, synthetic construct
  misc_feature 1..48: note = derived and/or modified sequence opt3 from anti-influenza_CDR
  source 1..48: mol_type = other RNA
aacatctactataccggcattacattctacaatcccagcctgtcctct

SEQ ID NO: 30230 - RNA, 48 nt, synthetic construct
  misc_feature 1..48: note = derived and/or modified sequence opt3 from anti-influenza_CDR
  source 1..48: mol_type = other RNA
ttcatctactatggcgggaacaccaagtacaatcccagcctgaaatcc

SEQ ID NO: 30231 - RNA, 48 nt, synthetic construct
  misc_feature 1..48: note = derived and/or modified sequence opt3 from anti-influenza_CDR
  source 1..48: mol_type = other RNA
ttcatgtttcacagcggctcccccagatacaaccctaccctgaagtct

SEQ ID NO: 30232 - RNA, 48 nt, synthetic construct
  misc_feature 1..48: note = derived and/or modified sequence opt3 from anti-influenza_CDR
  source 1..48: mol_type = other RNA
ttcttttacaacggcgggagcaccaagtataatccctccctgaaatct

SEQ ID NO: 30233 - RNA, 48 nt, synthetic construct
  misc_feature 1..48: note = derived and/or modified sequence opt3 from anti-influenza_CDR
  source 1..48: mol_type = other RNA
cacatctacgactatggcagaaccttctacaacagctccctgcagtct

SEQ ID NO: 30234 - RNA, 48 nt, synthetic construct
  misc_feature 1..48: note = derived and/or modified sequence opt3 from anti-influenza_CDR
  source 1..48: mol_type = other RNA
gtgttctacagcgagaccagaacatattacgccgactccgtcaagggc

SEQ ID NO: 30235 - RNA, 48 nt, synthetic construct
  misc_feature 1..48: note = derived and/or modified sequence opt3 from anti-influenza_CDR
  source 1..48: mol_type = other RNA
tacgtgtataacagaggcagcaccaagtactccccctctctgaaatca

SEQ ID NO: 30236 - RNA, 48 nt, synthetic construct
  misc_feature 1..48: note = derived and/or modified sequence opt3 from anti-influenza_CDR
  source 1..48: mol_type = other RNA
tacatctataacagaggcagcaccaagtacacaccctccctgaaatct

SEQ ID NO: 30237 - RNA, 48 nt, synthetic construct
  misc_feature 1..48: note = derived and/or modified sequence opt3 from anti-influenza_CDR
  source 1..48: mol_type = other RNA
tacctgtattacagcggctccaccaagtataacccctctctcaaatca

SEQ ID NO: 30238 - RNA, 48 nt, synthetic construct
  misc_feature 1..48: note = derived and/or modified sequence opt3 from anti-influenza_CDR
  source 1..48: mol_type = other RNA
tacgtgtataacagcggcaataccaagtacaacccctccctgaaatct

SEQ ID NO: 30239 - RNA, 48 nt, synthetic construct
  misc_feature 1..48: note = derived and/or modified sequence opt3 from anti-influenza_CDR
  source 1..48: mol_type = other RNA
cacatcttcgacagcggctccacctactataacccctctctgaagtca

SEQ ID NO: 30240 - RNA, 48 nt, synthetic construct
  misc_feature 1..48: note = derived and/or modified sequence opt3 from anti-influenza_CDR
  source 1..48: mol_type = other RNA
gtgttctacagcgccgacagaacctcctatgctgattctgtcaagggc

SEQ ID NO: 30241 - RNA, 48 nt, synthetic construct
  misc_feature 1..48: note = derived and/or modified sequence opt3 from anti-influenza_CDR
  source 1..48: mol_type = other RNA
tacatctattacagcggcaacacctattacaatccctccctgaagtct

SEQ ID NO: 30242 - RNA, 48 nt, synthetic construct
  misc_feature 1..48: note = derived and/or modified sequence opt3 from anti-influenza_CDR
  source 1..48: mol_type = other RNA
agaagctcccagtctctgctccactcaaacggctacaattatcttgac

SEQ ID NO: 30243 - RNA, 48 nt, synthetic construct
  misc_feature 1..48: note = derived and/or modified sequence opt3 from anti-influenza_CDR
  source 1..48: mol_type = other RNA
accatctaccacagcggctccacatattacaacccctctctgaagtca

SEQ ID NO: 30244 - RNA, 48 nt, synthetic construct
  misc_feature 1..48: note = derived and/or modified sequence opt3 from anti-influenza_CDR
  source 1..48: mol_type = other RNA
agaagctcccagtctctgctccactcaaacggccatatctacttcgac

SEQ ID NO: 30245 - RNA, 48 nt, synthetic construct
  misc_feature 1..48: note = derived and/or modified sequence opt3 from anti-influenza_CDR
  source 1..48: mol_type = other RNA
atctggggcgtggccgctcccagcaccgcatccgcccagacatctctg

SEQ ID NO: 30246 - RNA, 48 nt, synthetic construct
  misc_feature 1..48: note = derived and/or modified sequence opt3 from anti-influenza_CDR
  source 1..48: mol_type = other RNA
agaagctcccagtctctgctctacaccgacggcttcacatatctttca

SEQ ID NO: 30247 - RNA, 48 nt, synthetic construct
  misc_feature 1..48: note = derived and/or modified sequence opt3 from anti-influenza_CDR
  source 1..48: mol_type = other RNA
gccaagcccagactggactacctcgattatttccacgctgcagacagc

SEQ ID NO: 30248 - RNA, 48 nt, synthetic construct
  misc_feature 1..48: note = derived and/or modified sequence opt3 from anti-influenza_CDR
  source 1..48: mol_type = other RNA
gccagaagccccggctactccgggtatctgtacggatggttcgaccct

SEQ ID NO: 30249 - RNA, 48 nt, synthetic construct
  misc_feature 1..48: note = derived and/or modified sequence opt3 from anti-influenza_CDR
  source 1..48: mol_type = other RNA
gccatcgctggcagcgggtccgcagactacgcctcttgggcgaaggga

SEQ ID NO: 30250 - RNA, 48 nt, synthetic construct
  misc_feature 1..48: note = derived and/or modified sequence opt3 from anti-influenza_CDR
  source 1..48: mol_type = other RNA
gccatcgctggcagcgggtccgcagactacgcctcttgggcgaagtca

SEQ ID NO: 30251 - RNA, 48 nt, synthetic construct
  misc_feature 1..48: note = derived and/or modified sequence opt3 from anti-influenza_CDR
  source 1..48: mol_type = other RNA
gccatcggcgggggaggtagcgctgactacgcatcctgggccaagtct

SEQ ID NO: 30252 - RNA, 48 nt, synthetic construct
  misc_feature 1..48: note = derived and/or modified sequence opt3 from anti-influenza_CDR
  source 1..48: mol_type = other RNA
agaagctcccagtctctgctcaggtcaaacggctacaattatcttgac

SEQ ID NO: 30253 - RNA, 48 nt, synthetic construct
  misc_feature 1..48: note = derived and/or modified sequence opt3 from anti-influenza_CDR
  source 1..48: mol_type = other RNA
cagggcgaccacatcgcctggctgctcagagggattaacttcgattac

SEQ ID NO: 30254 - RNA, 51 nt, synthetic construct
  misc_feature 1..51: note = derived and/or modified sequence opt3 from anti-influenza_CDR
  source 1..51: mol_type = other RNA
gccagactgggcagcgggtcctaccacaacggacccaattggttcgaccct

SEQ ID NO: 30255 - RNA, 51 nt, synthetic construct
  misc_feature 1..51: note = derived and/or modified sequence opt3 from anti-influenza_CDR
  source 1..51: mol_type = other RNA
gccagagctgagaacctgctcagcccctaccttgcagaaggcttcgaccct

SEQ ID NO: 30256 - RNA, 51 nt, synthetic construct
  misc_feature 1..51: note = derived and/or modified sequence opt3 from anti-influenza_CDR
  source 1..51: mol_type = other RNA
gtgatcagctacgacggctccaacaagtattacgccgattctgtcaaaggg

SEQ ID NO: 30257 - RNA, 51 nt, synthetic construct
  misc_feature 1..51: note = derived and/or modified sequence opt3 from anti-influenza_CDR
  source 1..51: mol_type = other RNA
ggcaccatccccctgctcgggacaactaactacgcccagaagttccaagga

SEQ ID NO: 30258 - RNA, 51 nt, synthetic construct
  misc_feature 1..51: note = derived and/or modified sequence opt3 from anti-influenza_CDR
  source 1..51: mol_type = other RNA
ggcatcattgccgtgttcaacaccgctaattacgcacagaagtttcaaggg

SEQ ID NO: 30259 - RNA, 51 nt, synthetic construct
  misc_feature 1..51: note = derived and/or modified sequence opt3 from anti-influenza_CDR
  source 1..51: mol_type = other RNA
aacatcgaggacgatggcggggacaagtactatgtggatagcgtcaaagga

SEQ ID NO: 30260 - RNA, 51 nt, synthetic construct
  misc_feature 1..51: note = derived and/or modified sequence opt3 from anti-influenza_CDR
  source 1..51: mol_type = other RNA
tggatcaaccccaatagcggcaccacagggtccgcccagagattccaagga

SEQ ID NO: 30261 - RNA, 51 nt, synthetic construct
  misc_feature 1..51: note = derived and/or modified sequence opt3 from anti-influenza_CDR
  source 1..51: mol_type = other RNA
ggcatcaaccccgtgttcgggagacctcactacgcccagaagtttcaagga

SEQ ID NO: 30262 - RNA, 51 nt, synthetic construct
  misc_feature 1..51: note = derived and/or modified sequence opt3 from anti-influenza_CDR
  source 1..51: mol_type = other RNA
ggcatcattcccctgataaacgcccctaattacgctccaaagttccagggg

SEQ ID NO: 30263 - RNA, 51 nt, synthetic construct
  misc_feature 1..51: note = derived and/or modified sequence opt3 from anti-influenza_CDR
  source 1..51: mol_type = other RNA
ggcatcattcccatgatggggaccgtgaactacgcccagaagctgcaagga

SEQ ID NO: 30264 - RNA, 51 nt, synthetic construct
  misc_feature 1..51: note = derived and/or modified sequence opt3 from anti-influenza_CDR
  source 1..51: mol_type = other RNA
ggcatcattcccctgttcggggccgctaagtacgcacagaaatttcaagga

SEQ ID NO: 30265 - RNA, 51 nt, synthetic construct
  misc_feature 1..51: note = derived and/or modified sequence opt3 from anti-influenza_CDR
  source 1..51: mol_type = other RNA
aagagctcccagagagtgctgtactcttcaaacaataaaaactatctcgcc

SEQ ID NO: 30266 - RNA, 51 nt, synthetic construct
  misc_feature 1..51: note = derived and/or modified sequence opt3 from anti-influenza_CDR
  source 1..51: mol_type = other RNA
ctgatcagcgacgatggctccaacaagttctacgccgactctgtgaaaggg

SEQ ID NO: 30267 - RNA, 51 nt, synthetic construct
  misc_feature 1..51: note = derived and/or modified sequence opt3 from anti-influenza_CDR
  source 1..51: mol_type = other RNA
atcattagctacgacggcaacgatcagtattacaccgactccgtgaagggg

SEQ ID NO: 30268 - RNA, 51 nt, synthetic construct
  misc_feature 1..51: note = derived and/or modified sequence opt3 from anti-influenza_CDR
  source 1..51: mol_type = other RNA
tggatcagcacctacaacggcaatacaaacttcgcccagaattttcaaggg

SEQ ID NO: 30269 - RNA, 51 nt, synthetic construct
  misc_feature 1..51: note = derived and/or modified sequence opt3 from anti-influenza_CDR
  source 1..51: mol_type = other RNA
gtggagggcagctacagagacttctggaacaatcagaacaggtttgatccc

SEQ ID NO: 30270 - RNA, 51 nt, synthetic construct
  misc_feature 1..51: note = derived and/or modified sequence opt3 from anti-influenza_CDR
  source 1..51: mol_type = other RNA
tggatcaaccccaatagcggcgacaccaactacgcccagaagttccaaggg

SEQ ID NO: 30271 - RNA, 51 nt, synthetic construct
  misc_feature 1..51: note = derived and/or modified sequence opt3 from anti-influenza_CDR
  source 1..51: mol_type = other RNA
aagagctcccagtctgtgctgtactcaagtaacaataaaagccacctcgcc

SEQ ID NO: 30272 - RNA, 51 nt, synthetic construct
  misc_feature 1..51: note = derived and/or modified sequence opt3 from anti-influenza_CDR
  source 1..51: mol_type = other RNA
atcatttaccccggcgacagcgataccagatattccccttctttccagggg

SEQ ID NO: 30273 - RNA, 51 nt, synthetic construct
  misc_feature 1..51: note = derived and/or modified sequence opt3 from anti-influenza_CDR
  source 1..51: mol_type = other RNA
ggcatcattcccgtgttccctaccccaaactacgcccagatgtttcaaggg

SEQ ID NO: 30274 - RNA, 51 nt, synthetic construct
  misc_feature 1..51: note = derived and/or modified sequence opt3 from anti-influenza_CDR
  source 1..51: mol_type = other RNA
ggcatcgtgcccgtcttcgggaccgccaactacgctcagaagtttcaagga

SEQ ID NO: 30275 - RNA, 51 nt, synthetic construct
  misc_feature 1..51: note = derived and/or modified sequence opt3 from anti-influenza_CDR
  source 1..51: mol_type = other RNA
tggatcaaccccgagagcggcgacaccaagtacgcccagaaattccaaggg

SEQ ID NO: 30276 - RNA, 51 nt, synthetic construct
  misc_feature 1..51: note = derived and/or modified sequence opt3 from anti-influenza_CDR
  source 1..51: mol_type = other RNA
agaagctcccagtctatcttccacaactcaaataacgagaattacctggcc

SEQ ID NO: 30277 - RNA, 51 nt, synthetic construct
  misc_feature 1..51: note = derived and/or modified sequence opt3 from anti-influenza_CDR
  source 1..51: mol_type = other RNA
tggatcaacgccaagagaggcgggaccaattacgctcagaaattccaagga

SEQ ID NO: 30278 - RNA, 51 nt, synthetic construct
  misc_feature 1..51: note = derived and/or modified sequence opt3 from anti-influenza_CDR
  source 1..51: mol_type = other RNA
tggatcaaccccgacagcggcgccacctcctctgctcagaatttccaaggg

SEQ ID NO: 30279 - RNA, 51 nt, synthetic construct
  misc_feature 1..51: note = derived and/or modified sequence opt3 from anti-influenza_CDR
  source 1..51: mol_type = other RNA
tggatcagccccgactccgatgccaccaagtacgctcagaaattccaaggc

SEQ ID NO: 30280 - RNA, 51 nt, synthetic construct
  misc_feature 1..51: note = derived and/or modified sequence opt3 from anti-influenza_CDR
  source 1..51: mol_type = other RNA
aacatcaagcaggacggcagagagaaatactatgtggatagcctgaggggg

SEQ ID NO: 30281 - RNA, 51 nt, synthetic construct
  misc_feature 1..51: note = derived and/or modified sequence opt3 from anti-influenza_CDR
  source 1..51: mol_type = other RNA
ggcatcattgccatattcgggacccccaagtacgctcagaaatttcaagga

SEQ ID NO: 30282 - RNA, 51 nt, synthetic construct
  misc_feature 1..51: note = derived and/or modified sequence opt3 from anti-influenza_CDR
  source 1..51: mol_type = other RNA
aagagctcccagtctatcctgaactcaagtaataacaaaaattacctcgcc

SEQ ID NO: 30283 - RNA, 51 nt, synthetic construct
  misc_feature 1..51: note = derived and/or modified sequence opt3 from anti-influenza_CDR
  source 1..51: mol_type = other RNA
tggatcagcgcctacaacggcaataccaactatgctcagaagttccaaggg

SEQ ID NO: 30284 - RNA, 51 nt, synthetic construct
  misc_feature 1..51: note = derived and/or modified sequence opt3 from anti-influenza_CDR
  source 1..51: mol_type = other RNA
ggcgtgatccccattttcagaaccgccaactacgctcagaattttcaaggg

SEQ ID NO: 30285 - RNA, 51 nt, synthetic construct
  misc_feature 1..51: note = derived and/or modified sequence opt3 from anti-influenza_CDR
  source 1..51: mol_type = other RNA
ggcatcattgccatattccacacccccaagtacgctcagaaatttcaaggg

SEQ ID NO: 30286 - RNA, 51 nt, synthetic construct
  misc_feature 1..51: note = derived and/or modified sequence opt3 from anti-influenza_CDR
  source 1..51: mol_type = other RNA
ggcatcagccccatgttcgggaccacaacttacgcccagaagtttcaagga

SEQ ID NO: 30287 - RNA, 51 nt, synthetic construct
  misc_feature 1..51: note = derived and/or modified sequence opt3 from anti-influenza_CDR
  source 1..51: mol_type = other RNA
aagagctcccagtctgtgctgtactcaagtaacaataaaaactatctcgcc

SEQ ID NO: 30288 - RNA, 51 nt, synthetic construct
  misc_feature 1..51: note = derived and/or modified sequence opt3 from anti-influenza_CDR
  source 1..51: mol_type = other RNA
ggcatcattcccatattcgggaccacaaagtacgcccctaaatttcaggga

SEQ ID NO: 30289 - RNA, 51 nt, synthetic construct
  misc_feature 1..51: note = derived and/or modified sequence opt3 from anti-influenza_CDR
  source 1..51: mol_type = other RNA
ggcatcagccccctgttcgggaccacaaactacgcccagaagtttcaagga

SEQ ID NO: 30290 - RNA, 51 nt, synthetic construct
  misc_feature 1..51: note = derived and/or modified sequence opt3 from anti-influenza_CDR
  source 1..51: mol_type = other RNA
ggcatcatggggatgttcggaaccacaaactacgcccagaagtttcaaggt

SEQ ID NO: 30291 - RNA, 51 nt, synthetic construct
  misc_feature 1..51: note = derived and/or modified sequence opt3 from anti-influenza_CDR
  source 1..51: mol_type = other RNA
ggcatcattgggatgttcggaagcaccaactacgcccagaattttcaaggt

SEQ ID NO: 30292 - RNA, 51 nt, synthetic construct
  misc_feature 1..51: note = derived and/or modified sequence opt3 from anti-influenza_CDR
  source 1..51: mol_type = other RNA
tggatcaaccccaatagcggcgggaccaactacgcccagaagttccaagga

SEQ ID NO: 30293 - RNA, 51 nt, synthetic construct
  misc_feature 1..51: note = derived and/or modified sequence opt3 from anti-influenza_CDR
  source 1..51: mol_type = other RNA
gccatcagctcctctggcgactcaacctactatgctgatagtgtgaagggg

SEQ ID NO: 30294 - RNA, 51 nt, synthetic construct
  misc_feature 1..51: note = derived and/or modified sequence opt3 from anti-influenza_CDR
  source 1..51: mol_type = other RNA
agcatctcctcttcaagtagctacatttattacgtggactccgtcaagggc

SEQ ID NO: 30295 - RNA, 51 nt, synthetic construct
  misc_feature 1..51: note = derived and/or modified sequence opt3 from anti-influenza_CDR
  source 1..51: mol_type = other RNA
gacatcattggcatgttcgggagcaccaactacgcccagaattttcaagga

SEQ ID NO: 30296 - RNA, 51 nt, synthetic construct
  misc_feature 1..51: note = derived and/or modified sequence opt3 from anti-influenza_CDR
  source 1..51: mol_type = other RNA
ggcatcattcccatgttcgggaccacaaactacgcccagaagtttcaagga

SEQ ID NO: 30297 - RNA, 51 nt, synthetic construct
  misc_feature 1..51: note = derived and/or modified sequence opt3 from anti-influenza_CDR
  source 1..51: mol_type = other RNA
ggcatcattgccatattcgggaccgctaactacgcacagaagtttcaagga

SEQ ID NO: 30298 - RNA, 51 nt, synthetic construct
  misc_feature 1..51: note = derived and/or modified sequence opt3 from anti-influenza_CDR
  source 1..51: mol_type = other RNA
ggcatcattcccatattcgggaccacaaactacgcccagaagtttcaagga

SEQ ID NO: 30299 - RNA, 51 nt, synthetic construct
  misc_feature 1..51: note = derived and/or modified sequence opt3 from anti-influenza_CDR
  source 1..51: mol_type = other RNA
ggcatcttcgccctgtttgggaccacagactacgctcagaagttccaagga

SEQ ID NO: 30300 - RNA, 51 nt, synthetic construct
  misc_feature 1..51: note = derived and/or modified sequence opt3 from anti-influenza_CDR
  source 1..51: mol_type = other RNA
ggcatcattgggatgttcggaaccgccaactacgctcagaagtttcaaggt

SEQ ID NO: 30301 - RNA, 51 nt, synthetic construct
  misc_feature 1..51: note = derived and/or modified sequence opt3 from anti-influenza_CDR
  source 1..51: mol_type = other RNA
ggcatcattgccgtgttcgggaccacaaagtacgctcacaaatttcaggga

SEQ ID NO: 30302 - RNA, 51 nt, synthetic construct
  misc_feature 1..51: note = derived and/or modified sequence opt3 from anti-influenza_CDR
  source 1..51: mol_type = other RNA
ggcatcctgggggtgttcggaagcccctcctacgcccagaagtttcaaggt

SEQ ID NO: 30303 - RNA, 51 nt, synthetic construct
  misc_feature 1..51: note = derived and/or modified sequence opt3 from anti-influenza_CDR
  source 1..51: mol_type = other RNA
ggcatcttcgggatgtttggaaccgccaactacgctcagaagttccaaggt

SEQ ID NO: 30304 - RNA, 51 nt, synthetic construct
  misc_feature 1..51: note = derived and/or modified sequence opt3 from anti-influenza_CDR
  source 1..51: mol_type = other RNA
tggatcagcgcctacaccggcgacacagattatgctcagaagttccaaggg

SEQ ID NO: 30305 - RNA, 51 nt, synthetic construct
  misc_feature 1..51: note = derived and/or modified sequence opt3 from anti-influenza_CDR
  source 1..51: mol_type = other RNA
agcttcgaccccgaggatggcgaaaccatctacgcccagaagtttcaaggg

SEQ ID NO: 30306 - RNA, 51 nt, synthetic construct
  misc_feature 1..51: note = derived and/or modified sequence opt3 from anti-influenza_CDR
  source 1..51: mol_type = other RNA
ggcatcagcgggtccggagagtctacctactatgccgactcagtgaagggt

SEQ ID NO: 30307 - RNA, 51 nt, synthetic construct
  misc_feature 1..51: note = derived and/or modified sequence opt3 from anti-influenza_CDR
  source 1..51: mol_type = other RNA
gtggtcagctacgacggcaactataagtactatgccgattccgttcagggg

SEQ ID NO: 30308 - RNA, 51 nt, synthetic construct
  misc_feature 1..51: note = derived and/or modified sequence opt3 from anti-influenza_CDR
  source 1..51: mol_type = other RNA
ggcagcatcagctactctgggtcaacctattaccaccccagtctgaagtcc

SEQ ID NO: 30309 - RNA, 51 nt, synthetic construct
  misc_feature 1..51: note = derived and/or modified sequence opt3 from anti-influenza_CDR
  source 1..51: mol_type = other RNA
accagaggcaggcccatcgggcggaactgggagcctcgcgacaaggattac

SEQ ID NO: 30310 - RNA, 51 nt, synthetic construct
  misc_feature 1..51: note = derived and/or modified sequence opt3 from anti-influenza_CDR
  source 1..51: mol_type = other RNA
gccagagaggctggctaccacagctccttctctggggtgtattttgactac

SEQ ID NO: 30311 - RNA, 51 nt, synthetic construct
  misc_feature 1..51: note = derived and/or modified sequence opt3 from anti-influenza_CDR
  source 1..51: mol_type = other RNA
agaatcgaccccaacggcagcgggaccacatacgcccagaagttccaagga

SEQ ID NO: 30312 - RNA, 51 nt, synthetic construct
  misc_feature 1..51: note = derived and/or modified sequence opt3 from anti-influenza_CDR
  source 1..51: mol_type = other RNA
agaatcgaccccaacggcgccgggaccacatacgctcagaagttccaagga

SEQ ID NO: 30313 - RNA, 51 nt, synthetic construct
  misc_feature 1..51: note = derived and/or modified sequence opt3 from anti-influenza_CDR
  source 1..51: mol_type = other RNA
tggatcgaccccaacaatgatggcaccatttacgcccagaagttccaaggg

SEQ ID NO: 30314 - RNA, 51 nt, synthetic construct
  misc_feature 1..51: note = derived and/or modified sequence opt3 from anti-influenza_CDR
  source 1..51: mol_type = other RNA
atgatgtaccccggcgacagcgataccatctattccccttctttccagggg

SEQ ID NO: 30315 - RNA, 51 nt, synthetic construct
  misc_feature 1..51: note = derived and/or modified sequence opt3 from anti-influenza_CDR
  source 1..51: mol_type = other RNA
atgatgtaccccggcgacgccgatgctatctatagcccttccttccagggg

SEQ ID NO: 30316 - RNA, 51 nt, synthetic construct
  misc_feature 1..51: note = derived and/or modified sequence opt3 from anti-influenza_CDR
  source 1..51: mol_type = other RNA
atgatgtaccccggcgagagcgaaaccatctattccccttctttccagggg

SEQ ID NO: 30317 - RNA, 51 nt, synthetic construct
  misc_feature 1..51: note = derived and/or modified sequence opt3 from anti-influenza_CDR
  source 1..51: mol_type = other RNA
atgatgtaccccggcgacgccgataccatctatagcccttccttccagggg

SEQ ID NO: 30318 - RNA, 51 nt, synthetic construct
  misc_feature 1..51: note = derived and/or modified sequence opt3 from anti-influenza_CDR
  source 1..51: mol_type = other RNA
atgatgtaccccggcagctccgacaccatctattctccttcattccagggg

SEQ ID NO: 30319 - RNA, 51 nt, synthetic construct
  misc_feature 1..51: note = derived and/or modified sequence opt3 from anti-influenza_CDR
  source 1..51: mol_type = other RNA
atgatgtaccccggcgacagcgatgccatctattccccttctttccagggg

SEQ ID NO: 30320 - RNA, 51 nt, synthetic construct
  misc_feature 1..51: note = derived and/or modified sequence opt3 from anti-influenza_CDR
  source 1..51: mol_type = other RNA
atgatgtaccccggcgacaccgatacaatctatagcccttccttccagggg

SEQ ID NO: 30321 - RNA, 51 nt, synthetic construct
  misc_feature 1..51: note = derived and/or modified sequence opt3 from anti-influenza_CDR
  source 1..51: mol_type = other RNA
atgatgtaccccggcgagagcgacaccatctattccccttctttccagggg

SEQ ID NO: 30322 - RNA, 51 nt, synthetic construct
  misc_feature 1..51: note = derived and/or modified sequence opt3 from anti-influenza_CDR
  source 1..51: mol_type = other RNA
gtgatcagctgggactccggcagaattgggtacgccgattctgtcaaggga

SEQ ID NO: 30323 - RNA, 51 nt, synthetic construct
  misc_feature 1..51: note = derived and/or modified sequence opt3 from anti-influenza_CDR
  source 1..51: mol_type = other RNA
gtgagaagcggcgcctactatttcaactacctggtcccctattttgactac

SEQ ID NO: 30324 - RNA, 51 nt, synthetic construct
  misc_feature 1..51: note = derived and/or modified sequence opt3 from anti-influenza_CDR
  source 1..51: mol_type = other RNA
gtgagaagcggcgcctactatgtcaactacctggttccctatttcgactac

SEQ ID NO: 30325 - RNA, 51 nt, synthetic construct
  misc_feature 1..51: note = derived and/or modified sequence opt3 from anti-influenza_CDR
  source 1..51: mol_type = other RNA
atcattagctgggactccggcagaatagggtacgccgattctgtgagggga

SEQ ID NO: 30326 - RNA, 51 nt, synthetic construct
  misc_feature 1..51: note = derived and/or modified sequence opt3 from anti-influenza_CDR
  source 1..51: mol_type = other RNA
cacggcggggtgtactattacggaagcgcctcctctggttggttcgacccc

SEQ ID NO: 30327 - RNA, 54 nt, synthetic construct
  misc_feature 1..54: note = derived and/or modified sequence opt3 from anti-influenza_CDR
  source 1..54: mol_type = other RNA
agaacctactataggagcaagtggtacaacgactatgccgagtccgtgaaatct

SEQ ID NO: 30328 - RNA, 54 nt, synthetic construct
  misc_feature 1..54: note = derived and/or modified sequence opt3 from anti-influenza_CDR
  source 1..54: mol_type = other RNA
agaacctactataggagcaagtggtactatgactacgccgagtccgtgaaatct

SEQ ID NO: 30329 - RNA, 54 nt, synthetic construct
  misc_feature 1..54: note = derived and/or modified sequence opt3 from anti-influenza_CDR
  source 1..54: mol_type = other RNA
agaacctactataggagcaagtggtacaacgactatgccgtgtccgtcaaatct

SEQ ID NO: 30330 - RNA, 54 nt, synthetic construct
  misc_feature 1..54: note = derived and/or modified sequence opt3 from anti-influenza_CDR
  source 1..54: mol_type = other RNA
agaacctactataggagcaagtggtacaacgactatgccgatttcctgaaacgg

SEQ ID NO: 30331 - RNA, 54 nt, synthetic construct
  misc_feature 1..54: note = derived and/or modified sequence opt3 from anti-influenza_CDR
  source 1..54: mol_type = other RNA
agaacctactataggagcggctggtacaacgactatgccgagtccgtgaagtct

SEQ ID NO: 30332 - RNA, 54 nt, synthetic construct
  misc_feature 1..54: note = derived and/or modified sequence opt3 from anti-influenza_CDR
  source 1..54: mol_type = other RNA
gccagactgggcgggaacaaggactacggagattatctctggtacttcgacctt

SEQ ID NO: 30333 - RNA, 54 nt, synthetic construct
  misc_feature 1..54: note = derived and/or modified sequence opt3 from anti-influenza_CDR
  source 1..54: mol_type = other RNA
gccaaggacaccgctgatcacggcgactacgtggatctggggttctttgacgca

SEQ ID NO: 30334 - RNA, 54 nt, synthetic construct
  misc_feature 1..54: note = derived and/or modified sequence opt3 from anti-influenza_CDR
  source 1..54: mol_type = other RNA
gccagaagcggcatcttcgactggtccgctcccctggtggaggcatttgatatt

SEQ ID NO: 30335 - RNA, 54 nt, synthetic construct
  misc_feature 1..54: note = derived and/or modified sequence opt3 from anti-influenza_CDR
  source 1..54: mol_type = other RNA
gccagacacgctagctgctccgcaaggtcttgttactggggccccgtggactat

SEQ ID NO: 30336 - RNA, 54 nt, synthetic construct
  misc_feature 1..54: note = derived and/or modified sequence opt3 from anti-influenza_CDR
  source 1..54: mol_type = other RNA
gacgctccccctaacgtggaggtcgccagcatgaccaattggtacttcgatctg

SEQ ID NO: 30337 - RNA, 54 nt, synthetic construct
  misc_feature 1..54: note = derived and/or modified sequence opt3 from anti-influenza_CDR
  source 1..54: mol_type = other RNA
ctgagaaccgactacggcgatcccgacagcgtgtattactatgggatggatgtc

SEQ ID NO: 30338 - RNA, 54 nt, synthetic construct
  misc_feature 1..54: note = derived and/or modified sequence opt3 from anti-influenza_CDR
  source 1..54: mol_type = other RNA
gggacctgcgccggcgactgtagcctgcactactattactatggactcgatgtg

SEQ ID NO: 30339 - RNA, 54 nt, synthetic construct
  misc_feature 1..54: note = derived and/or modified sequence opt3 from anti-influenza_CDR
  source 1..54: mol_type = other RNA
cacgtgagcgtctcccatggcgggagaaccaagtctaacccctcagttatgagt

SEQ ID NO: 30340 - RNA, 54 nt, synthetic construct
  misc_feature 1..54: note = derived and/or modified sequence opt3 from anti-influenza_CDR
  source 1..54: mol_type = other RNA
gccctgatctacttcgacggcagcaagcagtattacgctgattccgtgaaaggg

SEQ ID NO: 30341 - RNA, 54 nt, synthetic construct
  misc_feature 1..54: note = derived and/or modified sequence opt3 from anti-influenza_CDR
  source 1..54: mol_type = other RNA
accctgatcagctacgacggcgccaaccagtattacgctgattccgtgaagggg

SEQ ID NO: 30342 - RNA, 54 nt, synthetic construct
  misc_feature 1..54: note = derived and/or modified sequence opt3 from anti-influenza_CDR
  source 1..54: mol_type = other RNA
gccgtgcccggccctgtcttcgggatctttccaccgtggagctacttcgacaac

SEQ ID NO: 30343 - RNA, 54 nt, synthetic construct
  misc_feature 1..54: note = derived and/or modified sequence opt3 from anti-influenza_CDR
  source 1..54: mol_type = other RNA
ggcgggatcattcccatattcggagccgctaactacgcacagaagtttcaaggt

SEQ ID NO: 30344 - RNA, 54 nt, synthetic construct
  misc_feature 1..54: note = derived and/or modified sequence opt3 from anti-influenza_CDR
  source 1..54: mol_type = other RNA
ggctggatcagcgcctacaccgggaacacacactatgctaagaatttcgaggga

SEQ ID NO: 30345 - RNA, 54 nt, synthetic construct
  misc_feature 1..54: note = derived and/or modified sequence opt3 from anti-influenza_CDR
  source 1..54: mol_type = other RNA
ggctggatcaaccccaatttcgggggaacccactacgccagaaagtttcagggt

SEQ ID NO: 30346 - RNA, 54 nt, synthetic construct
  misc_feature 1..54: note = derived and/or modified sequence opt3 from anti-influenza_CDR
  source 1..54: mol_type = other RNA
gtgagatggagggccgctgcagtcatcatggaccagttctacaagatggatgtt

SEQ ID NO: 30347 - RNA, 54 nt, synthetic construct
  misc_feature 1..54: note = derived and/or modified sequence opt3 from anti-influenza_CDR
  source 1..54: mol_type = other RNA
gccgtgcccggccctatcttcgggatttttccaccgtggagctacttcgaccac

SEQ ID NO: 30348 - RNA, 54 nt, synthetic construct
  misc_feature 1..54: note = derived and/or modified sequence opt3 from anti-influenza_CDR
  source 1..54: mol_type = other RNA
gccgctagcaccgcaacatccggcacttactatgccatgagacccttcgacttt

SEQ ID NO: 30349 - RNA, 57 nt, synthetic construct
  misc_feature 1..57: note = derived and/or modified sequence opt3 from anti-influenza_CDR
  source 1..57: mol_type = other RNA
gccagaggcaagaggcccgggtactgcagcggaggtgtgtgttcctctgactattgg

SEQ ID NO: 30350 - RNA, 57 nt, synthetic construct
  misc_feature 1..57: note = derived and/or modified sequence opt3 from anti-influenza_CDR
  source 1..57: mol_type = other RNA
gccagacactacccctattacgacctgcctaccggcttctatagccagtttgatttc

SEQ ID NO: 30351 - RNA, 57 nt, synthetic construct
  misc_feature 1..57: note = derived and/or modified sequence opt3 from anti-influenza_CDR
  source 1..57: mol_type = other RNA
ggcagcgggggatacggtggcttcgactattttgggaagctgagaacctgggatttc

SEQ ID NO: 30352 - RNA, 57 nt, synthetic construct
  misc_feature 1..57: note = derived and/or modified sequence opt3 from anti-influenza_CDR
  source 1..57: mol_type = other RNA
ttcatcagaaccaggccctggggcgggacagccgacactgctgcaagcgtgaaggga

SEQ ID NO: 30353 - RNA, 57 nt, synthetic construct
  misc_feature 1..57: note = derived and/or modified sequence opt3 from anti-influenza_CDR
  source 1..57: mol_type = other RNA
ctgaactaccacgacagcggcacctattacaatgcccccagagggtggttcgatcct

SEQ ID NO: 30354 - RNA, 57 nt, synthetic construct
  misc_feature 1..57: note = derived and/or modified sequence opt3 from anti-influenza_CDR
  source 1..57: mol_type = other RNA
gtgaaggacggctactgcaccctgacaagctgtcccgtcgggtggtatttcgatctc

SEQ ID NO: 30355 - RNA, 57 nt, synthetic construct
  misc_feature 1..57: note = derived and/or modified sequence opt3 from anti-influenza_CDR
  source 1..57: mol_type = other RNA
gccgtgcccggccctatcttcgggatttttccaccgtggagctacttcgaccactgg

SEQ ID NO: 30356 - RNA, 57 nt, synthetic construct
  misc_feature 1..57: note = derived and/or modified sequence opt3 from anti-influenza_CDR
  source 1..57: mol_type = other RNA
gccagagctatgatccagggcgtggtcaccctgtacctcaggcccggggactattgg

SEQ ID NO: 30357 - RNA, 57 nt, synthetic construct
  misc_feature 1..57: note = derived and/or modified sequence opt3 from anti-influenza_CDR
  source 1..57: mol_type = other RNA
gccaaggtgggcccctacaccgggtatgacgattacaactattacggaatggacgtc

SEQ ID NO: 30358 - RNA, 57 nt, synthetic construct
  misc_feature 1..57: note = derived and/or modified sequence opt3 from anti-influenza_CDR
  source 1..57: mol_type = other RNA
gccaaggtggagagatccttctacgacggcagcgggtatggagatgctctggaaatc

SEQ ID NO: 30359 - RNA, 57 nt, synthetic construct
  misc_feature 1..57: note = derived and/or modified sequence opt3 from anti-influenza_CDR
  source 1..57: mol_type = other RNA
tactgcgccagaggcagggtgaacagcgggtatgactggggacccaatttcgattcc

SEQ ID NO: 30360 - RNA, 57 nt, synthetic construct
  misc_feature 1..57: note = derived and/or modified sequence opt3 from anti-influenza_CDR
  source 1..57: mol_type = other RNA
ttctgcgccagaggcagccccaactccgggtacgactggggacctcactttgattat

SEQ ID NO: 30361 - RNA, 57 nt, synthetic construct
  misc_feature 1..57: note = derived and/or modified sequence opt3 from anti-influenza_CDR
  source 1..57: mol_type = other RNA
agaatcaagagcaacaccgacggcgggacaactgattacgccgctcccgtgaaagga

SEQ ID NO: 30362 - RNA, 57 nt, synthetic construct
  misc_feature 1..57: note = derived and/or modified sequence opt3 from anti-influenza_CDR
  source 1..57: mol_type = other RNA
ctgagactccagggcgaggtggtcgttccccctagccaatccaactggttcgaccca

SEQ ID NO: 30363 - RNA, 60 nt, synthetic construct
  misc_feature 1..60: note = derived and/or modified sequence opt3 from anti-influenza_CDR
  source 1..60: mol_type = other RNA
gccaaggagggcgggaacaccatcttcggactggtgacaatggcttactattttgacagc

SEQ ID NO: 30364 - RNA, 60 nt, synthetic construct
  misc_feature 1..60: note = derived and/or modified sequence opt3 from anti-influenza_CDR
  source 1..60: mol_type = other RNA
gccagagctggcggggacagctccggatactatggtgcactgggcaggttctttcagcac

SEQ ID NO: 30365 - RNA, 60 nt, synthetic construct
  misc_feature 1..60: note = derived and/or modified sequence opt3 from anti-influenza_CDR
  source 1..60: mol_type = other RNA
gccaaggacagcagaggctactgctcctctatcatttgtttcgagggagggctggataac

SEQ ID NO: 30366 - RNA, 60 nt, synthetic construct
  misc_feature 1..60: note = derived and/or modified sequence opt3 from anti-influenza_CDR
  source 1..60: mol_type = other RNA
ggcagcgggtcctctgacagatcagattacgacccccactattactattacctggatgtg

SEQ ID NO: 30367 - RNA, 60 nt, synthetic construct
  misc_feature 1..60: note = derived and/or modified sequence opt3 from anti-influenza_CDR
  source 1..60: mol_type = other RNA
ggcaccgaccccgatacagaggtgtactgcagagtcgggaactgtgccgctttcgactat

SEQ ID NO: 30368 - RNA, 60 nt, synthetic construct
  misc_feature 1..60: note = derived and/or modified sequence opt3 from anti-influenza_CDR
  source 1..60: mol_type = other RNA
ggcaccagccacgtgtccagatacttcgactggctgccccctacaaactggtttgatcca

SEQ ID NO: 30369 - RNA, 60 nt, synthetic construct
  misc_feature 1..60: note = derived and/or modified sequence opt3 from anti-influenza_CDR
  source 1..60: mol_type = other RNA
ggcaccgaccccgatacagaggggtactgcagaagcggatcctgttctgccttcgacttt

SEQ ID NO: 30370 - RNA, 60 nt, synthetic construct
  misc_feature 1..60: note = derived and/or modified sequence opt3 from anti-influenza_CDR
  source 1..60: mol_type = other RNA
ggcaccgaccccgatacagaggtgtactgcagagccgggaactgtgctgcattcgacttt

SEQ ID NO: 30371 - RNA, 60 nt, synthetic construct
  misc_feature 1..60: note = derived and/or modified sequence opt3 from anti-influenza_CDR
  source 1..60: mol_type = other RNA
agaggcgggcacagcttcggatacggttccggcggggacacccattctgagtttgattca

SEQ ID NO: 30372 - RNA, 60 nt, synthetic construct
  misc_feature 1..60: note = derived and/or modified sequence opt3 from anti-influenza_CDR
  source 1..60: mol_type = other RNA
cacatgagcatgcagcaagtggtctccgccggctgggagagagctgacctggttggggat

SEQ ID NO: 30373 - RNA, 60 nt, synthetic construct
  misc_feature 1..60: note = derived and/or modified sequence opt3 from anti-influenza_CDR
  source 1..60: mol_type = other RNA
gacagcagactgaggtccctcctttacttcgagtggctgtctcagggctattttaacccc

SEQ ID NO: 30374 - RNA, 60 nt, synthetic construct
  misc_feature 1..60: note = derived and/or modified sequence opt3 from anti-influenza_CDR
  source 1..60: mol_type = other RNA
gccagacacctgggccagcaactcgtgagcaacacctactattactatgggatggacgtc

SEQ ID NO: 30375 - RNA, 63 nt, synthetic construct
  misc_feature 1..63: note = derived and/or modified sequence opt3 from anti-influenza_CDR
  source 1..63: mol_type = other RNA
accacaggcgggactacgacctgcacagccgctggatgtggtggcgggtgctgtacttgctgt

SEQ ID NO: 30376 - RNA, 63 nt, synthetic construct
  misc_feature 1..63: note = derived and/or modified sequence opt3 from anti-influenza_CDR
  source 1..63: mol_type = other RNA
gccagagctgcagacgagagcgtggaatccctgaccatcaaggccttcaggacaaactaccac

SEQ ID NO: 30377 - RNA, 63 nt, synthetic construct
  misc_feature 1..63: note = derived and/or modified sequence opt3 from anti-influenza_CDR
  source 1..63: mol_type = other RNA
gccagaatgcccctggctaactacgacctccttaccggcctgtatatcggggcattcgatttg

SEQ ID NO: 30378 - RNA, 63 nt, synthetic construct
  misc_feature 1..63: note = derived and/or modified sequence opt3 from anti-influenza_CDR
  source 1..63: mol_type = other RNA
gacatgctggcctactatagcgataactccggcaagaaatacaatgtgtatgggatggacgtc

SEQ ID NO: 30379 - RNA, 63 nt, synthetic construct
  misc_feature 1..63: note = derived and/or modified sequence opt3 from anti-influenza_CDR
  source 1..63: mol_type = other RNA
gacatgctggcctactattacgatggcagcgggatcagatataacctctacggaatggacgtg

SEQ ID NO: 30380 - RNA, 66 nt, synthetic construct
  misc_feature 1..66: note = derived and/or modified sequence opt3 from anti-influenza_CDR
  source 1..66: mol_type = other RNA
gccaaggaccccagactgaggcacctcctttacttcccttttaccagcatgatctatttcgattac

SEQ ID NO: 30381 - RNA, 66 nt, synthetic construct
  misc_feature 1..66: note = derived and/or modified sequence opt3 from anti-influenza_CDR
  source 1..66: mol_type = other RNA
gccaaggacagccagctgagatccctcctttacttcgagtggctgtctcaaggctattttgatccc

SEQ ID NO: 30382 - RNA, 66 nt, synthetic construct
  misc_feature 1..66: note = derived and/or modified sequence opt3 from anti-influenza_CDR
  source 1..66: mol_type = other RNA
gccaaggacagccagctgagatccctcctttacttcgagtggctgtctcaaggctattttgattac

SEQ ID NO: 30383 - RNA, 66 nt, synthetic construct
  misc_feature 1..66: note = derived and/or modified sequence opt3 from anti-influenza_CDR
  source 1..66: mol_type = other RNA
gccaaggacagccagctgagatccctcctttacttcgagtggctgtctcaaggctattttgaaccc

SEQ ID NO: 30384 - RNA, 66 nt, synthetic construct
  misc_feature 1..66: note = derived and/or modified sequence opt3 from anti-influenza_CDR
  source 1..66: mol_type = other RNA
gccaaggagagacccctgaggctccttcggtacttcgactggctgagcggcggggctaacgattat

SEQ ID NO: 30385 - RNA, 66 nt, synthetic construct
  misc_feature 1..66: note = derived and/or modified sequence opt3 from anti-influenza_CDR
  source 1..66: mol_type = other RNA
gccagagacgtgcacaactacgatttcctgaccggctatcccctccatctttacgggatggacgtc

SEQ ID NO: 30386 - RNA, 66 nt, synthetic construct
  misc_feature 1..66: note = derived and/or modified sequence opt3 from anti-influenza_CDR
  source 1..66: mol_type = other RNA
gccagagacggcagggaggggtacttctatggaagcggttccttttacaacctgaagggcctcaat

SEQ ID NO: 30387 - RNA, 66 nt, synthetic construct
  misc_feature 1..66: note = derived and/or modified sequence opt3 from anti-influenza_CDR
  source 1..66: mol_type = other RNA
agcaccgacagaggccacgtgctgaggtacttcgggtggatgctccccggagatgcctttgacgtc

SEQ ID NO: 30388 - RNA, 66 nt, synthetic construct
  misc_feature 1..66: note = derived and/or modified sequence opt3 from anti-influenza_CDR
  source 1..66: mol_type = other RNA
ctgaactactatgacagaagcggctaccactcccccgatgggccttctaataactggttcgaccca

SEQ ID NO: 30389 - RNA, 66 nt, synthetic construct
  misc_feature 1..66: note = derived and/or modified sequence opt3 from anti-influenza_CDR
  source 1..66: mol_type = other RNA
gccagagtgcccagggaccggctgctcaccctttactatgagagctccacatacggcttcgattat

SEQ ID NO: 30390 - RNA, 66 nt, synthetic construct
  misc_feature 1..66: note = derived and/or modified sequence opt3 from anti-influenza_CDR
  source 1..66: mol_type = other RNA
gccagaaagtggggcaggatgaccgtgttcggggtcgctacagaccagctgtactattttgattac

SEQ ID NO: 30391 - RNA, 66 nt, synthetic construct
  misc_feature 1..66: note = derived and/or modified sequence opt3 from anti-influenza_CDR
  source 1..66: mol_type = other RNA
gccaccgacatcgtggtcgagagagatgctagcctgggcgggttcaactcctacggaatggacgtt

SEQ ID NO: 30392 - RNA, 69 nt, synthetic construct
  misc_feature 1..69: note = derived and/or modified sequence opt3 from anti-influenza_CDR
  source 1..69: mol_type = other RNA
gccagaaacctgcccgacatcgctgtggtcaccgcagttcaggatgccacacctgtgtggttcgaccca

SEQ ID NO: 30393 - RNA, 69 nt, synthetic construct
  misc_feature 1..69: note = derived and/or modified sequence opt3 from anti-influenza_CDR
  source 1..69: mol_type = other RNA
gacggcccctacagcgatgacttcagatccgggtatgccgctaggtaccggtattttggaatggatgtg

SEQ ID NO: 30394 - RNA, 72 nt, synthetic construct
  misc_feature 1..72: note = derived and/or modified sequence opt3 from anti-influenza_CDR
  source 1..72: mol_type = other RNA
ggcagagagctgctcaggcttcagcacttcctgaccgacagccaatccgaacggcgcgattgctttgacccc

SEQ ID NO: 30395 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacgagtggggctgtaggtgcaatgactcctctgat

SEQ ID NO: 30396 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactaagaacgagtgggaatgcagatgtaatgactcctctgat

SEQ ID NO: 30397 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtgggaatgtaggtgcaatgactcctctgat

SEQ ID NO: 30398 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacggctgggagtgcaagtgtaatgactcctctgat

SEQ ID NO: 30399 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagatccgagtggggctgtaggtgcaacgactcttcagat

SEQ ID NO: 30400 - RNA, 72 nt, synthetic construct
  misc_feature 1..72: note = derived and/or modified sequence opt3 from anti-influenza_CDR
  source 1..72: mol_type = other RNA
atgagcttcctgcccgaggtggaaacccctatcagaaacgagtggggctgtaggtgcaatgactcctctgat

SEQ ID NO: 30401 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtggggctgtaggtgcaatgactcctctaac

SEQ ID NO: 30402 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaaggagtggggctgtaggtgcaacgactcctctgat

SEQ ID NO: 30403 - RNA, 72 nt, synthetic construct
  misc_feature 1..72: note = derived and/or modified sequence opt3 from anti-influenza_CDR
  source 1..72: mol_type = other RNA
atgagcttcctgaccgaggtggaaacacccatcagaaacgagtggggctgtaggtgcaatgactcctctgat

SEQ ID NO: 30404 - RNA, 72 nt, synthetic construct
  misc_feature 1..72: note = derived and/or modified sequence opt3 from anti-influenza_CDR
  source 1..72: mol_type = other RNA
atgagcctgcccaccgaggtggaaacacctatcagatccgagtggggctgtaggtgcaacgactcttcagat

SEQ ID NO: 30405 - RNA, 72 nt, synthetic construct
  misc_feature 1..72: note = derived and/or modified sequence opt3 from anti-influenza_CDR
  source 1..72: mol_type = other RNA
atgagcctgctccccgaggtggaaacccctatcagaaacgagtggggctgtaggtgcaatgactcctctgat

SEQ ID NO: 30406 - RNA, 72 nt, synthetic construct
  misc_feature 1..72: note = derived and/or modified sequence opt3 from anti-influenza_CDR
  source 1..72: mol_type = other RNA
atgagcctgctccccgaggtggaaacccctatcagaaacggctgggggtgtaggtgcaatgactcctctgat

SEQ ID NO: 30407 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacggctgggagtgtaggtgctccgggtcttcagac

SEQ ID NO: 30408 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtgggaatacaggtgcaatgactcctctgat

SEQ ID NO: 30409 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtgggaatacaggtgctccgactcttcagat

SEQ ID NO: 30410 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacggctgggagtgcaggtactccgactcttcagat

SEQ ID NO: 30411 - RNA, 72 nt, synthetic construct
  misc_feature 1..72: note = derived and/or modified sequence opt3 from anti-influenza_CDR
  source 1..72: mol_type = other RNA
atgagcttcctgaccgaggtggaaacactcactagaaacggctgggagtgtaggtgctccgactcttcagat

SEQ ID NO: 30412 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacttactagaaacggctgggagtgcaagtgtagggactcctctgat

SEQ ID NO: 30413 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtggggctgtaggtgcaatgactcctctgat

SEQ ID NO: 30414 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagatccgagtggggctgtaggtgcaacgactctggggat

SEQ ID NO: 30415 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtgggaatgtaggtgcaatggctcctctgac

SEQ ID NO: 30416 - RNA, 72 nt, synthetic construct
  misc_feature 1..72: note = derived and/or modified sequence opt3 from anti-influenza_CDR
  source 1..72: mol_type = other RNA
atgagcctgcccaccgaggtggaaacacctatcagaaacgagtggggctgtaggtgcaatgactcctctgat

SEQ ID NO: 30417 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtggggctgtaggtgcaatgggtcctctgac

SEQ ID NO: 30418 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggacacacttactagaaacggctgggggtgtaggtgctccgattcttcagac

SEQ ID NO: 30419 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacttactaagaacggctgggggtgcagatgttccgactcttcagat

SEQ ID NO: 30420 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacggctgggagtgcaagtgttccgactcttcagat

SEQ ID NO: 30421 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacacactagaaacggctgggagtgcaagtgttccgactcttcagat

SEQ ID NO: 30422 - RNA, 72 nt, synthetic construct
  misc_feature 1..72: note = derived and/or modified sequence opt3 from anti-influenza_CDR
  source 1..72: mol_type = other RNA
atgagcctgctcaccgaggtgaagacacccactagaaacggctgggaatgcaaatgttccgactcttcagat

SEQ ID NO: 30423 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacttactagaaacggctgggggtgtaggtgctccgactcttcagat

SEQ ID NO: 30424 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagagacggctgggagtgcaagtgttccgattcttcagac

SEQ ID NO: 30425 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacggctgggggtgtaggtgctccgactcttcagat

SEQ ID NO: 30426 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacggctgggagtgcaagtgtaatgactcctctgat

SEQ ID NO: 30427 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacttactagaaacggctgggagtgcaagtgttccgactcttcagat

SEQ ID NO: 30428 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaacgagtggggctgcaagtgtaatgactcctctgat

SEQ ID NO: 30429 - RNA, 72 nt, synthetic construct
  misc_feature 1..72: note = derived and/or modified sequence opt3 from anti-influenza_CDR
  source 1..72: mol_type = other RNA
atgagcttcctgaccgaggtggaaacacccatcagaaacgagtggggctgtaggtgcaatgggtcctctgac

SEQ ID NO: 30430 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacggctgggagtgtaggtgcaatgactcctctgat

SEQ ID NO: 30431 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccatcagaaagggctgggagtgcaactgttccgactcttcagat

SEQ ID NO: 30432 - RNA, 72 nt, synthetic construct
  misc_feature 1..72: note = derived and/or modified sequence opt3 from anti-influenza_CDR
  source 1..72: mol_type = other RNA
atgagcctgctcaccgaggtggaaacacccactagaaacgagtgggaatgtaggtgctccgactcttcagat

SEQ ID NO: 30433 - RNA, 72 nt, synthetic construct
  misc_feature 1..72: note = derived and/or modified sequence opt3 from anti-influenza_CDR
  source 1..72: mol_type = other RNA
atgagcctgctcaccggcgtggagacacacactagaaacgggtggggatgcaagtgttccgactcttcagat

SEQ ID NO: 30434 - RNA, 72 nt, synthetic construct
  misc_feature 1..72: note = derived and/or modified sequence opt3 from anti-influenza_CDR
  source 1..72: mol_type = other RNA
atgagcctgctccccgaggtggaaacccacacaagaaacggctgggggtgtaggtgctccgactcttcagat

SEQ ID NO: 30435 - RNA, 72 nt, synthetic construct
  misc_feature 1..72: note = derived and/or modified sequence opt3 from anti-influenza_CDR
  source 1..72: mol_type = other RNA
accgacggcccctacagcgatgacttcagatccgggtatgccgctaggtaccggtattttggaatggatgtg

SEQ ID NO: 30436 - RNA, 75 nt, synthetic construct
  misc_feature 1..75: note = derived and/or modified sequence opt3 from anti-influenza_CDR
  source 1..75: mol_type = other RNA
gccaagcacatgagcctgcagcaagtggtctccgctggctgggagagagcagacctcgttggggatgccttcgac

SEQ ID NO: 30437 - RNA, 75 nt, synthetic construct
  misc_feature 1..75: note = derived and/or modified sequence opt3 from anti-influenza_CDR
  source 1..75: mol_type = other RNA
gccaagcacctgagcatgcagcaagtggtctccgctggctgggagagagcagacctcgttggggatgccttcgac

SEQ ID NO: 30438 - RNA, 75 nt, synthetic construct
  misc_feature 1..75: note = derived and/or modified sequence opt3 from anti-influenza_CDR
  source 1..75: mol_type = other RNA
gccaagcacgctagcctgcagcaagtggtctccgcaggctgggagagagccgacctcgttggggatgcgttcgac

SEQ ID NO: 30439 - RNA, 75 nt, synthetic construct
  misc_feature 1..75: note = derived and/or modified sequence opt3 from anti-influenza_CDR
  source 1..75: mol_type = other RNA
gccaagcacagctccctgcagcaagtggtctctgctggctgggagagagcagacctcgttggggatgccttcgac

SEQ ID NO: 30440 - RNA, 75 nt, synthetic construct
  misc_feature 1..75: note = derived and/or modified sequence opt3 from anti-influenza_CDR
  source 1..75: mol_type = other RNA
gccaagcacctgagcctccagcaagtggtctccgctggctgggagagagcagaccttgttggggatgccttcgac

SEQ ID NO: 30441 - RNA, 75 nt, synthetic construct
  misc_feature 1..75: note = derived and/or modified sequence opt3 from anti-influenza_CDR
  source 1..75: mol_type = other RNA
gccaagcacatgagcatgcagcaagtggtctccgctggctgggagagagcagacctggttggggatgccttcgac

SEQ ID NO: 30442 - RNA, 75 nt, synthetic construct
  misc_feature 1..75: note = derived and/or modified sequence opt3 from anti-influenza_CDR
  source 1..75: mol_type = other RNA
gccagaggccccgagacctactattacgacaagacaaactggctgaatagccaccctgatgaatatttccagcat

SEQ ID NO: 30443 - RNA, 75 nt, synthetic construct
  misc_feature 1..75: note = derived and/or modified sequence opt3 from anti-influenza_CDR
  source 1..75: mol_type = other RNA
accacagacggcccctacagcgatgacttcagatccgggtatgccgctaggtaccggtattttggaatggatgtg

SEQ ID NO: 30444 - RNA, 75 nt, synthetic construct
  misc_feature 1..75: note = derived and/or modified sequence opt3 from anti-influenza_CDR
  source 1..75: mol_type = other RNA
accgacggcccctacagcgatgacttcagatccgggtatgccgctaggtaccggtattttggaatggatgtgtgg

SEQ ID NO: 30445 - RNA, 78 nt, synthetic construct
  misc_feature 1..78: note = derived and/or modified sequence opt3 from anti-influenza_CDR
  source 1..78: mol_type = other RNA
gacatccagatgacccaaagcccctcctctctgtcagccagtgtgggcgatagagtcacaattacttgcaggagctcc

SEQ ID NO: 30446 - RNA, 78 nt, synthetic construct
  misc_feature 1..78: note = derived and/or modified sequence opt3 from anti-influenza_CDR
  source 1..78: mol_type = other RNA
gccaccggcagagctgcaacagggagcgcctcctgcactggaggtggcacgtactggacctattgtacatgcactacc

SEQ ID NO: 30447 - RNA, 81 nt, synthetic construct
  misc_feature 1..81: note = derived and/or modified sequence opt3 from anti-influenza_CDR
  source 1..81: mol_type = other RNA
ggctacatccccgaggcccctagagacgggcaggcttatgtgaggaaggatggagaatgggtcctgctcagcaccttcctt

SEQ ID NO: 30448 - RNA, 90 nt, synthetic construct
  misc_feature 1..90: note = derived and/or modified sequence opt3 from anti-influenza_CDR
  source 1..90: mol_type = other RNA
caggtgcaactgctcgagaccggcgggggacttgtcaagcccggtcagagcctgaaattgtcctgcgccgcttctggcttcacatttact

SEQ ID NO: 30449 - RNA, 96 nt, synthetic construct
  misc_feature 1..96: note = derived and/or modified sequence opt3 from anti-influenza_CDR
  source 1..96: mol_type = other RNA
agattcaccatcagcagggacaactccaagaatacactgtacctccagatgaactctcttcgggccgaggatactgctgtgtattactgcgcaaaa

SEQ ID NO: 30450 - RNA, 96 nt, synthetic construct
  misc_feature 1..96: note = derived and/or modified sequence opt3 from anti-influenza_CDR
  source 1..96: mol_type = other RNA
ggcgtgcccagcagattctccgggtctggatcaggtaccgactttacactgactatcagtagcctccagcctgaggatttcgccacgtactattgc

SEQ ID NO: 30451 - RNA, 15 nt, synthetic construct
  misc_feature 1..15: note = derived and/or modified sequence opt3 from anti-OX40_HeavyChain_CDR1
  source 1..15: mol_type = other RNA
agctactccatgaac

SEQ ID NO: 30452 - RNA, 15 nt, synthetic construct
  misc_feature 1..15: note = derived and/or modified sequence opt3 from anti-OX40_HeavyChain_CDR1
  source 1..15: mol_type = other RNA
gactacgccatgcac

SEQ ID NO: 30453 - RNA, 15 nt, synthetic construct
  misc_feature 1..15: note = derived and/or modified sequence opt3 from anti-OX40_HeavyChain_CDR1
  source 1..15: mol_type = other RNA
gacagctacatgtcc

SEQ ID NO: 30454 - RNA, 15 nt, synthetic construct
  misc_feature 1..15: note = derived and/or modified sequence opt3 from anti-OX40_HeavyChain_CDR1
  source 1..15: mol_type = other RNA
gacgcctacatgagc

SEQ ID NO: 30455 - RNA, 15 nt, synthetic construct
  misc_feature 1..15: note = derived and/or modified sequence opt3 from anti-OX40_HeavyChain_CDR1
  source 1..15: mol_type = other RNA
gagagctacatgtcc

SEQ ID NO: 30456 - RNA, 15 nt, synthetic construct
  misc_feature 1..15: note = derived and/or modified sequence opt3 from anti-OX40_HeavyChain_CDR1
  source 1..15: mol_type = other RNA
agcggctactggaac

SEQ ID NO: 30457 - RNA, 21 nt, synthetic construct
  misc_feature 1..21: note = derived and/or modified sequence opt3 from anti-OX40_LightChain_CDR2
  source 1..21: mol_type = other RNA
tacaccagcagactgcactcc

SEQ ID NO: 30458 - RNA, 21 nt, synthetic construct
  misc_feature 1..21: note = derived and/or modified sequence opt3 from anti-OX40_LightChain_CDR2
  source 1..21: mol_type = other RNA
gccgctagctccctgcagtct

SEQ ID NO: 30459 - RNA, 21 nt, synthetic construct
  misc_feature 1..21: note = derived and/or modified sequence opt3 from anti-OX40_LightChain_CDR2
  source 1..21: mol_type = other RNA
gacgccagcaacagagctacc

SEQ ID NO: 30460 - RNA, 21 nt, synthetic construct
  misc_feature 1..21: note = derived and/or modified sequence opt3 from anti-OX40_LightChain_CDR2
  source 1..21: mol_type = other RNA
tacaccagcagactgaggtcc

SEQ ID NO: 30461 - RNA, 24 nt, synthetic construct
  misc_feature 1..24: note = derived and/or modified sequence opt3 from anti-OX40_LightChain_CDR3
  source 1..24: mol_type = other RNA
cagcaaagaagcaactggcccacc

SEQ ID NO: 30462 - RNA, 24 nt, synthetic construct
  misc_feature 1..24: note = derived and/or modified sequence opt3 from anti-OX40_HeavyChain_CDR3
  source 1..24: mol_type = other RNA
gcccccagatggtacttcagcgtg

SEQ ID NO: 30463 - RNA, 24 nt, synthetic construct
  misc_feature 1..24: note = derived and/or modified sequence opt3 from anti-OX40_HeavyChain_CDR3
  source 1..24: mol_type = other RNA
gcccccagatggtacttcagcgct

SEQ ID NO: 30464 - RNA, 24 nt, synthetic construct
  misc_feature 1..24: note = derived and/or modified sequence opt3 from anti-OX40_HeavyChain_CDR3
  source 1..24: mol_type = other RNA
gcccccagatggtacttcgctgtg

SEQ ID NO: 30465 - RNA, 27 nt, synthetic construct
  misc_feature 1..27: note = derived and/or modified sequence opt3 from anti-OX40_LightChain_CDR3
  source 1..27: mol_type = other RNA
cagcaaggcaacaccctgccctggaca

SEQ ID NO: 30466 - RNA, 27 nt, synthetic construct
  misc_feature 1..27: note = derived and/or modified sequence opt3 from anti-OX40_HeavyChain_CDR3
  source 1..27: mol_type = other RNA
gagagcggctggtacctgttcgactat

SEQ ID NO: 30467 - RNA, 27 nt, synthetic construct
  misc_feature 1..27: note = derived and/or modified sequence opt3 from anti-OX40_LightChain_CDR3
  source 1..27: mol_type = other RNA
cagcaatacaacagctatccccctacc

SEQ ID NO: 30468 - RNA, 27 nt, synthetic construct
  misc_feature 1..27: note = derived and/or modified sequence opt3 from anti-OX40_LightChain_CDR3
  source 1..27: mol_type = other RNA
cagcaaggccacaccctgccccctaca

SEQ ID NO: 30469 - RNA, 27 nt, synthetic construct
  misc_feature 1..27: note = derived and/or modified sequence opt3 from anti-OX40_LightChain_CDR3
  source 1..27: mol_type = other RNA
cagcaaggccacaccctgcccgccaca

SEQ ID NO: 30470 - RNA, 27 nt, synthetic construct
  misc_feature 1..27: note = derived and/or modified sequence opt3 from anti-OX40_LightChain_CDR3
  source 1..27: mol_type = other RNA
cagcaaggccacaccgcccctcccaca

SEQ ID NO: 30471 - RNA, 27 nt, synthetic construct
  misc_feature 1..27: note = derived and/or modified sequence opt3 from anti-OX40_LightChain_CDR3
  source 1..27: mol_type = other RNA
cagcaaggcgccaccctgccccctaca

SEQ ID NO: 30472 - RNA, 27 nt, synthetic construct
  misc_feature 1..27: note = derived and/or modified sequence opt3 from anti-OX40_LightChain_CDR3
  source 1..27: mol_type = other RNA
cagcaaggccacgccctgccccctacc

SEQ ID NO: 30473 - RNA, 27 nt, synthetic construct
  misc_feature 1..27: note = derived and/or modified sequence opt3 from anti-OX40_LightChain_CDR3
  source 1..27: mol_type = other RNA
cagcaagcccacaccctgccccctaca

SEQ ID NO: 30474 - RNA, 27 nt, synthetic construct
  misc_feature 1..27: note = derived and/or modified sequence opt3 from anti-OX40_LightChain_CDR3
  source 1..27: mol_type = other RNA
cagcaaggccacaccctggcccccaca

SEQ ID NO: 30475 - RNA, 27 nt, synthetic construct
  misc_feature 1..27: note = derived and/or modified sequence opt3 from anti-OX40_LightChain_CDR3
  source 1..27: mol_type = other RNA
caggccggccacaccctgccccctaca

SEQ ID NO: 30476 - RNA, 30 nt, synthetic construct
  misc_feature 1..30: note = derived and/or modified sequence opt3 from anti-OX40_HeavyChain_CDR1
  source 1..30: mol_type = other RNA
ggctacaccttcacaagctatgtgatgcac

SEQ ID NO: 30477 - RNA, 30 nt, synthetic construct
  misc_feature 1..30: note = derived and/or modified sequence opt3 from anti-OX40_HeavyChain_CDR3
  source 1..30: mol_type = other RNA
tactatggcagctccctgtctatggactac

SEQ ID NO: 30478 - RNA, 33 nt, synthetic construct
  misc_feature 1..33: note = derived and/or modified sequence opt3 from anti-OX40_LightChain_CDR1
  source 1..33: mol_type = other RNA
agagccagccaggacatctccaactacctgaat

SEQ ID NO: 30479 - RNA, 33 nt, synthetic construct
  misc_feature 1..33: note = derived and/or modified sequence opt3 from anti-OX40_LightChain_CDR1
  source 1..33: mol_type = other RNA
agagccagccagggcatctcctcttggctggct

SEQ ID NO: 30480 - RNA, 33 nt, synthetic construct; identical to SEQ ID NO: 29998
  misc_feature 1..33: note = derived and/or modified sequence opt3 from anti-OX40_LightChain_CDR1
  source 1..33: mol_type = other RNA

SEQ ID NO: 30481 - RNA, 39 nt, synthetic construct
  misc_feature 1..39: note = derived and/or modified sequence opt3 from anti-OX40_HeavyChain_CDR3
  source 1..39: mol_type = other RNA
tacagatatgactacgatggcgggcacgccatggactat

SEQ ID NO: 30482 - RNA, 39 nt, synthetic construct
  misc_feature 1..39: note = derived and/or modified sequence opt3 from anti-OX40_HeavyChain_CDR3
  source 1..39: mol_type = other RNA
tacaagtatgactacgatgccggccacgctatggactat

SEQ ID NO: 30483 - RNA, 39 nt, synthetic construct
  misc_feature 1..39: note = derived and/or modified sequence opt3 from anti-OX40_HeavyChain_CDR3
  source 1..39: mol_type = other RNA
tacaagtatgactacgatggcgggcacgccatggactat

SEQ ID NO: 30484 - RNA, 45 nt, synthetic construct
  misc_feature 1..45: note = derived and/or modified sequence opt3 from anti-OX40_HeavyChain_CDR3
  source 1..45: mol_type = other RNA
gaccagagcaccgccgattactatttctactatggcatggacgtg

SEQ ID NO: 30485 - RNA, 48 nt, synthetic construct
  misc_feature 1..48: note = derived and/or modified sequence opt3 from anti-OX40_HeavyChain_CDR2
  source 1..48: mol_type = other RNA
tacatcagctataacggcattacctaccacaatccctccctgaagtct

SEQ ID NO: 30486 - RNA, 48 nt, synthetic construct
  misc_feature 1..48: note = derived and/or modified sequence opt3 from anti-OX40_HeavyChain_CDR2
  source 1..48: mol_type = other RNA
tacatcagctataacgccattacctaccacaatccctccctgaagtct

SEQ ID NO: 30487 - RNA, 48 nt, synthetic construct
  misc_feature 1..48: note = derived and/or modified sequence opt3 from anti-OX40_HeavyChain_CDR2
  source 1..48: mol_type = other RNA
tacatcagctattccggcattacctaccacaacccctctctgaagtca

SEQ ID NO: 30488 - RNA, 51 nt, synthetic construct
  misc_feature 1..51: note = derived and/or modified sequence opt3 from anti-OX40_HeavyChain_CDR2
  source 1..51: mol_type = other RNA
tacatcaacccctataatgacggcaccaagtacaacgagaaattcaagggg

SEQ ID NO: 30489 - RNA, 51 nt, synthetic construct
  misc_feature 1..51: note = derived and/or modified sequence opt3 from anti-OX40_HeavyChain_CDR2
  source 1..51: mol_type = other RNA
tacatcagctcctcttcaagtaccattgactatgccgatagcgtgaagggc

SEQ ID NO: 30490 - RNA, 51 nt, synthetic construct
  misc_feature 1..51: note = derived and/or modified sequence opt3 from anti-OX40_HeavyChain_CDR2
  source 1..51: mol_type = other RNA
ggcatcagctggaactccgggtctattggatacgccgactcagtgaagggt

SEQ ID NO: 30491 - RNA, 51 nt, synthetic construct
  misc_feature 1..51: note = derived and/or modified sequence opt3 from anti-OX40_HeavyChain_CDR2
  source 1..51: mol_type = other RNA
gacatgtaccccgataacggcgacagctcctataatcagaagttcagagag

SEQ ID NO: 30492 - RNA, 51 nt, synthetic construct
  misc_feature 1..51: note = derived and/or modified sequence opt3 from anti-OX40_HeavyChain_CDR2
  source 1..51: mol_type = other RNA
gacatgtaccccgataacgccgacagctcctataatcagaagttcagagag

SEQ ID NO: 30493 - RNA, 51 nt, synthetic construct
  misc_feature 1..51: note = derived and/or modified sequence opt3 from anti-OX40_HeavyChain_CDR2
  source 1..51: mol_type = other RNA
gacatgtaccccgataacgccgacgctagctataatcagaagttcagagag

SEQ ID NO: 30494 - RNA, 51 nt, synthetic construct
  misc_feature 1..51: note = derived and/or modified sequence opt3 from anti-OX40_HeavyChain_CDR2
  source 1..51: mol_type = other RNA
gacatgtaccccgataacggcgacgccagctataatcagaagttcagagag

SEQ ID NO: 30495 - RNA, 51 nt, synthetic construct
  misc_feature 1..51: note = derived and/or modified sequence opt3 from anti-OX40_HeavyChain_CDR2
  source 1..51: mol_type = other RNA
gacatgtaccccgatagcggcgactcctcttataaccagaagttcagagag

SEQ ID NO: 30496 - RNA, 51 nt, synthetic construct
  misc_feature 1..51: note = derived and/or modified sequence opt3 from anti-OX40_HeavyChain_CDR2
  source 1..51: mol_type = other RNA
gacatgtaccccgataacggcagctcctcttataatcagaagttcagagag

SEQ ID NO: 30497 - RNA, 309 nt, synthetic construct
  misc_feature 1..309: note = derived and/or modified sequence opt3 from Ig_LightChain_kappa_constant_domain
  source 1..309: mol_type = other RNA
accgtggccgctcccagcgtcttcatctttcctccatccgacgagcagctgaagtctggcacagcatcagttgtgtgcctccttaacaatttctacccgagagaagccaaagtacaatggaaggtggataacgcgctgcagagtgggaatagccaggagtccgtcactgaacaggactctaaagattcgacgtattcattgagcagtaccttaacactgtccaaggctgactacgagaaacacaaggtgtatgcctgtgaagttactcatcaaggactatctagccccgtgaccaagtcctttaacagg

SEQ ID NO: 30498 - RNA, 309 nt, synthetic construct
  misc_feature 1..309: note = derived and/or modified sequence opt3 from Ig_LightChain_kappa_constant_domain
  source 1..309: mol_type = other RNA
accgtggccgctcccagcgtcttcatctttcctccatccgacgagcagctgaagtctggcacagcatcagttgtgtgcctccttaacaatttctacccgagagaagccaaagtacaatggaaggtggataacgcgctgcagagtgggaatagccaggagtccgtcactgaacaggactctaaagattcgacgtattcattgagcaacaccttaacactgagtaaggctgactacgagaaacacaaggtgtatgcctgtgaagttactcatcaaggactatcctctcccgtgaccaagagctttaatagg

SEQ ID NO: 30499 - RNA, 312 nt, synthetic construct
  misc_feature 1..312: note = derived and/or modified sequence opt3 from Ig_LightChain_lambda_constant_domain
  source 1..312: mol_type = other RNA
cccaaggccgctcctagcgtgaccctgttcccaccgtcctctgaggaactccaggcaaacaaagccacacttgtctgcctgatctcagacttttaccccggcgcggttactgtggcttggaaggccgatagtagccctgtaaaagcaggggtggagacgaccacaccatccaagcaatctaataacaaatatgccgcttcgtcatacttgagcttaactcccgaacagtggaagagtcacagatcctattcttgtcaggtcacccatgagggaagcacagtggaaaagaccgttgcacctactgagtgctcc

SEQ ID NO: 30500 - RNA, 312 nt, synthetic construct
  misc_feature 1..312: note = derived and/or modified sequence opt3 from Ig_LightChain_lambda_constant_domain
  source 1..312: mol_type = other RNA
cccaaggccgctcctagcgtgaccctgttcccaccgtcctctgaggaactccaggcaaacaaagccacacttgtctgcctgatctcagacttttaccccggcgcggttactgtggcttggaaggccgatagtagccctgtaaaagcaggggtggagacgaccacaccatccaagcaatctaataacaaatatgccgcttcgtcatacttgagcttaactcccgaacagtggaagagtcacagatcctattcttgtcaggtcacccatgagggaagcacagtggaaaagaccgttgcccctgcagagtgctcc

SEQ ID NO: 30501 - RNA, 312 nt, synthetic construct
  misc_feature 1..312: note = derived and/or modified sequence opt3 from Ig_LightChain_lambda_constant_domain
  source 1..312: mol_type = other RNA
cccaaggccgctcctagcgtgaccctgttcccaccgtcctctgaggaactccaggcaaacaaagccacacttgtctgcctgatctcagacttttaccccggcgcggttactgtggcttggaaggccgatagtagccctgtaaaagcaggggtggagacgaccacaccatccaagcaatctaataacaaatatgccgcttcgtcatacttgagcttaactcccgaacagtggaagagtcacaagtcctattcttgtcaggtcacccatgagggaagcacagtggagaaaaccgttgcacctactgaatgctcc

SEQ ID NO: 30502 - RNA, 312 nt, synthetic construct
  misc_feature 1..312: note = derived and/or modified sequence opt3 from Ig_LightChain_lambda_constant_domain
  source 1..312: mol_type = other RNA
cccaaggccgctcctagcgtgaccctgttcccaccgtcctctgaggaactccaggcaaacaaagccacacttgtctgcctgatctcagacttttaccccggcgcggttactgtggcttggaaggccgatagtagccctgtaaaagcaggggtggagacgaccacaccatccaagcaatctaataacaaatatgccgcttcgtcatacttgagcttaactcccgaacagtggaagagtcacaagtcctattcttgtcaggtcacccatgagggaagcacagtggagaaaaccgttgcccctgcagaatgctcc

SEQ ID NO: 30503 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgttccctctggctccatcaagtaaaagcacatccgggggaactgcagccctcggttgccttgtcaaggactactttccggagcccgttacggtgtcttggaactcgggcgtacacaccttccctgcggtgctgcagtcaagcgggttgtatagtttatcctctgtcgtgacagttccaagctcctcactgggaactcaaacctacatctgtaatgtgaaccataaacccagtaatacaaaggtcgataaaaaggtg

SEQ ID NO: 30504 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgttccctctggccccatcttcaaagagtaccagcgggggaacagctgcactcggttgccttgtcaaagactactttccggagcccgttactgtgtcctggaactctggcgtacacacgttccctgccgtgctgcagtcgtcagggttgtatagcttaagttccgtcgtgaccgttccatctagctccctgggaacacaaacttacatctgtaatgtgaaccataagccctcaaataccaaagtcgataagaaagtg

SEQ ID NO: 30505 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgttccctctggccccatcttcaaagagtaccagcgggggaacagctgcactcggttgccttgtcaaagactactttccggagcccgttactgtgtcctggaactctggcgtacacacgttccctgccgtgctgcagtcgtcagggttgtatagcttaagttccgtcgtgaccgttccatctagctccctgggaacacaaacttacatctgtaatgtgaaccataagccctcaaataccaaagtcgataagaaagcg

SEQ ID NO: 30506 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgttccctctggccccatcttcaaagagtaccagcgggggaacagctgcactcggttgccttgtcaaagactactttccggagcccgttactgtgtcctggaactctggcgtacacacgttccctgccgtgctgcagtcgtcagggttgtatagcttaagttccgtcgtgaccgttccatctagctccctgggaacacaaacttacatctgtaatgtgaaccataagccctcaaataccaaagtcgataagagagtg

SEQ ID NO: 30507 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgttccctctggccccatcttcaaagagtaccagcgggggaacagctgcactcggttgccttgtcaaagactactttccggagcccgttactgtgtcctggaactctggcgtacacacgttccctgccgtgctgcagtcgtcagggttgtatagcttaagttccgtcgtgaccgttccatctagctccctgggaacacaaacttacatctgtaatgtgaaccataagccctcaaataccaaagtcgataagagagcg

SEQ ID NO: 30508 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgctgcctctcgccccatcttcaaagagtaccagcgggggaacagctgcacttggttgcctggtcaaagactacttcccggagcccgttactgtgtcctggaactctggcgtacacacgtttcctgccgtgttgcagtcgtcagggttatatagcctgagttccgtcgtgaccgttccatctagctccctaggaacacaaacttacatctgtaatgtgaaccataagccctcaaataccaaagtcgataagaaagtg

SEQ ID NO: 30509 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgctgcctctcgccccatcttcaaagagtaccagcgggggaacagctgcacttggttgcctggtcaaagactacttcccggagcccgttactgtgtcctggaactctggcgtacacacgtttcctgccgtgttgcagtcgtcagggttatatagcctgagttccgtcgtgaccgttccatctagctccctaggaacacaaacttacatctgtaatgtgaaccataagccctcaaataccaaagtcgataagaaagcg

SEQ ID NO: 30510 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgctgcctctcgccccatcttcaaagagtaccagcgggggaacagctgcacttggttgcctggtcaaagactacttcccggagcccgttactgtgtcctggaactctggcgtacacacgtttcctgccgtgttgcagtcgtcagggttatatagcctgagttccgtcgtgaccgttccatctagctccctaggaacacaaacttacatctgtaatgtgaaccataagccctcaaataccaaagtcgataagagagtg

SEQ ID NO: 30511 - RNA, 270 nt, synthetic construct
  misc_feature 1..270: note = derived and/or modified sequence opt3 from IgG1_HeavyChain_CH1_constant_domain
  source 1..270: mol_type = other RNA
agcggcccctccgtgctgcctctcgccccatcttcaaagagtaccagcgggggaacagctgcacttggttgcctggtcaaagactacttcccggagcccgttactgtgtcctggaactctggcgtacacacgtttcctgccgtgttgcagtcgtcagggttatatagcctgagttccgtcgtgaccgttccatctagctccctaggaacacaaacttacatctgtaatgtgaaccataagccctcaaataccaaagtcgataagagagcg

SEQ ID NO: 30512 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgttccctctggctccatcaagtaaaagcacatccgggggaactgcagccctcggttgccttgtcaaggactactttccggagcccgttacggtgtcttggaactcgggcgtacacaccttccctgcggtgctgcagtcaagcgggttgtatagtttatcctctgtcgtgacagttccaagctcctcactgggaactcaaacctacatctgtaatgtgaaccataaacccagtaatacaaaggtcgataaaaaggct

SEQ ID NO: 30513 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgttccctctggctccatcaagtaaaagcacatccgggggaactgcagccctcggttgccttgtcaaggactactttccggagcccgttacggtgtcttggaactcgggcgtacacaccttccctgcggtgctgcagtcaagcgggttgtatagtttatcctctgtcgtgacagttccaagctcctcactgggaactcaaacctacatctgtaatgtgaaccataaacccagtaatacaaaggtcgataaaagagtg

SEQ ID NO: 30514 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgttccctctggctccatcaagtaaaagcacatccgggggaactgcagccctcggttgccttgtcaaggactactttccggagcccgttacggtgtcttggaactcgggcgtacacaccttccctgcggtgctgcagtcaagcgggttgtatagtttatcctctgtcgtgacagttccaagctcctcactgggaactcaaacctacatctgtaatgtgaaccataaacccagtaatacaaaggtcgataaaagagct

SEQ ID NO: 30515 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgctgcctctcgctccatcaagtaaaagcacatccgggggaactgcagcccttggttgcctggtcaaggactacttcccggagcccgttacggtgtcttggaactcgggcgtacacacctttcctgcggtgttgcagtcaagcgggttatatagtctgtcctctgtcgtgacagttccaagctcctcactaggaactcaaacctacatctgtaatgtgaaccataaacccagtaatacaaaggtcgataaaaaggtg

SEQ ID NO: 30516 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgctgcctctcgctccatcaagtaaaagcacatccgggggaactgcagcccttggttgcctggtcaaggactacttcccggagcccgttacggtgtcttggaactcgggcgtacacacctttcctgcggtgttgcagtcaagcgggttatatagtctgtcctctgtcgtgacagttccaagctcctcactaggaactcaaacctacatctgtaatgtgaaccataaacccagtaatacaaaggtcgataaaaaggct

SEQ ID NO: 30517 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgctgcctctcgctccatcaagtaaaagcacatccgggggaactgcagcccttggttgcctggtcaaggactacttcccggagcccgttacggtgtcttggaactcgggcgtacacacctttcctgcggtgttgcagtcaagcgggttatatagtctgtcctctgtcgtgacagttccaagctcctcactaggaactcaaacctacatctgtaatgtgaaccataaacccagtaatacaaaggtcgataaaagagtg

SEQ ID NO: 30518 - RNA, 282 nt, synthetic construct
  misc_feature 1..282: note = derived and/or modified sequence opt3 from IgG1_HeavyChain_CH1_constant_domain
  source 1..282: mol_type = other RNA
agcgcctccaccaagggcccctctgtgctgcctctcgctccatcaagtaaaagcacatccgggggaactgcagcccttggttgcctggtcaaggactacttcccggagcccgttacggtgtcttggaactcgggcgtacacacctttcctgcggtgttgcagtcaagcgggttatatagtctgtcctctgtcgtgacagttccaagctcctcactaggaactcaaacctacatctgtaatgtgaaccataaacccagtaatacaaaggtcgataaaagagct

SEQ ID NO: 30519 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgggcctagcgtgttcctttttccaccgaagcccaaagacaccctgatgatctccagaacacctgaagtcacttgcgttgtggtagatgtgtctcacgaggacccagaagtcaagttcaactggtacgtggatggagttgaggtgcataatgctaaaacgaagcccagggaggaacagtataactcaacctaccgggtcgtgagtgtattgacagttttacaccaagactggctgaatggtaaagagtataagtgtaaggtgagcaacaaagcactacctgccccaattgaaaagactatatccaaagcgaag

SEQ ID NO: 30520 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgggcctagcgtgttcctttttccaccgaagcccaaagacaccctgatgatctccagaacacctgaagtcacttgcgttgtggtagatgtgtctcacgaggacccagaagtcaagttcaacgtgtacgttgatggagtggaggtccataatgctaaaacgaagcccagggaggaacagtataactcaacctaccgggtggtaagtgttttgacagtgttacaccaagactggctgaatggtaaagagtataagtgtaaggtcagcaacaaagcactacctgccccaattgaaaagactatatccaaagcgaag

SEQ ID NO: 30521 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgggcctagcgtgttcctttttccaccgaagcccaaagacaccctgatgatctccagaacacctgaagtcacttgcgttgtggtagatgtgtctcacgaggacccagaagtcaagttcaacgtgtacgttgatggagtggaggtccataatgctaaaacgaagcccagggaggaacagtatgcatcaacctaccgggtggtaagtgttttgacagtgttacaccaagactggctgaacggtaaagagtataagtgtaaggtcagcaataaagccctacctgcgccaattgaaaagactatatccaaagctaag

SEQ ID NO: 30522 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgggcctagcgtgttcctttttccaccgaagcccaaagacaccctgatgatctccagaacacctgaagtcacttgcgttgtggtagatgtgtctcacgaggacccagaagtcaagttcaactggtacgtggatggagttgaggtgcataatgctaaaacgaagcccagggaggaacagtatgcatcaacctaccgggtcgtgagtgtattgacagttttacaccaagactggctgaacggtaaagagtataagtgtaaggtgagcaataaagccctacctgcgccaattgaaaagactatatccaaagctaag

SEQ ID NO: 30523 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgctcctagcgtgttcctttttccaccgaagcccaaagacaccctgatgatctccagaacacctgaagtcacttgcgttgtggtagatgtgtctcacgaggacccagaagtcaagttcaacgtgtacgttgatggggtggaggtccataatgcaaaaacgaagcccagggaggaacagtataactcaacctaccgggtggtaagtgttttgacagtgttacaccaagactggctgaatggaaaagagtataagtgtaaggtcagcaacaaagccctacctgcgccaattgaaaagactatatccaaagctaag

SEQ ID NO: 30524 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgctcctagcgtgttcctttttccaccgaagcccaaagacaccctgatgatctccagaacacctgaagtcacttgcgttgtggtagatgtgtctcacgaggacccagaagtcaagttcaacgtgtacgttgatggggtggaggtccataatgcaaaaacgaagcccagggaggaacagtatgcctcaacctaccgggtggtaagtgttttgacagtgttacaccaagactggctgaacggaaaagagtataagtgtaaggtcagcaataaagcgctacctgctccaattgaaaagactatatccaaagccaag

SEQ ID NO: 30525 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgctcctagcgtgttcctttttccaccgaagcccaaagacaccctgatgatctccagaacacctgaagtcacttgcgttgtggtagatgtgtctcacgaggacccagaagtcaagttcaactggtacgtggatggggttgaggtgcataatgcaaaaacgaagcccagggaggaacagtataactcaacctaccgggtcgtgagtgtattgacagttttacaccaagactggctgaatggaaaagagtataagtgtaaggtgagcaacaaagccctacctgcgccaattgaaaagactatatccaaagctaag

SEQ ID NO: 30526 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctgctcggcgctcctagcgtgttcctttttccaccgaagcccaaagacaccctgatgatctccagaacacctgaagtcacttgcgttgtggtagatgtgtctcacgaggacccagaagtcaagttcaactggtacgtggatggggttgaggtgcataatgcaaaaacgaagcccagggaggaacagtatgcctcaacctaccgggtcgtgagtgtattgacagttttacaccaagactggctgaacggaaaagagtataagtgtaaggtgagcaataaagcgctacctgctccaattgaaaagactatatccaaagccaag

SEQ ID NO: 30527 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgggcctagcgtgttcctctttccaccgaagcccaaagacacccttatgatctccagaacacctgaagtcacttgcgttgtggtagatgtgtctcacgaggacccagaagtcaagttcaacgtgtacgttgatggagtggaggtccataatgcaaaaacgaagcccagggaggaacagtataactcaacctaccgggtggtaagtgttctgacagtgttgcaccaagactggttaaatggtaaagagtataagtgtaaggtcagcaacaaagccctgcctgcgccaattgaaaagactatatccaaagctaag

SEQ ID NO: 30528 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgggcctagcgtgttcctctttccaccgaagcccaaagacacccttatgatctccagaacacctgaagtcacttgcgttgtggtagatgtgtctcacgaggacccagaagtcaagttcaacgtgtacgttgatggagtggaggtccataatgcaaaaacgaagcccagggaggaacagtatgcctcaacctaccgggtggtaagtgttctgacagtgttgcaccaagactggttaaacggtaaagagtataagtgtaaggtcagcaataaagcgctgcctgctccaattgaaaagactatatccaaagccaag

SEQ ID NO: 30529 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgggcctagcgtgttcctctttccaccgaagcccaaagacacccttatgatctccagaacacctgaagtcacttgcgttgtggtagatgtgtctcacgaggacccagaagtcaagttcaactggtacgtggatggagttgaggtgcataatgcaaaaacgaagcccagggaggaacagtataactcaacctaccgggtcgtgagtgtactgacagttttgcaccaagactggttaaatggtaaagagtataagtgtaaggtgagcaacaaagccctgcctgcgccaattgaaaagactatatccaaagctaag

SEQ ID NO: 30530 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgggcctagcgtgttcctctttccaccgaagcccaaagacacccttatgatctccagaacacctgaagtcacttgcgttgtggtagatgtgtctcacgaggacccagaagtcaagttcaactggtacgtggatggagttgaggtgcataatgcaaaaacgaagcccagggaggaacagtatgcctcaacctaccgggtcgtgagtgtactgacagttttgcaccaagactggttaaacggtaaagagtataagtgtaaggtgagcaataaagcgctgcctgctccaattgaaaagactatatccaaagccaag

SEQ ID NO: 30531 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgcacctagcgtgttcctctttccaccgaagcccaaagacacccttatgatctccagaacacctgaagtcacttgcgttgtggtagatgtgtctcacgaggacccagaagtcaagttcaacgtgtacgttgatggggtggaggtccataatgccaaaacgaagcccagggaggaacagtataactcaacctaccgggtggtaagtgttctgacagtgttgcaccaagactggttaaatggaaaagagtataagtgtaaggtcagcaacaaagcgctgcctgctccaattgaaaagactatatccaaagccaag

SEQ ID NO: 30532 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgcacctagcgtgttcctctttccaccgaagcccaaagacacccttatgatctccagaacacctgaagtcacttgcgttgtggtagatgtgtctcacgaggacccagaagtcaagttcaacgtgtacgttgatggggtggaggtccataatgccaaaacgaagcccagggaggaacagtatgcgtcaacctaccgggtggtaagtgttctgacagtgttgcaccaagactggttaaacggaaaagagtataagtgtaaggtcagcaataaagctctgcctgccccaattgaaaagactatatccaaagcaaag

SEQ ID NO: 30533 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgcacctagcgtgttcctctttccaccgaagcccaaagacacccttatgatctccagaacacctgaagtcacttgcgttgtggtagatgtgtctcacgaggacccagaagtcaagttcaactggtacgtggatggggttgaggtgcataatgccaaaacgaagcccagggaggaacagtataactcaacctaccgggtcgtgagtgtactgacagttttgcaccaagactggttaaatggaaaagagtataagtgtaaggtgagcaacaaagcgctgcctgctccaattgaaaagactatatccaaagccaag

SEQ ID NO: 30534 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgagctggctggcgcacctagcgtgttcctctttccaccgaagcccaaagacacccttatgatctccagaacacctgaagtcacttgcgttgtggtagatgtgtctcacgaggacccagaagtcaagttcaactggtacgtggatggggttgaggtgcataatgccaaaacgaagcccagggaggaacagtatgcgtcaacctaccgggtcgtgagtgtactgacagttttgcaccaagactggttaaacggaaaagagtataagtgtaaggtgagcaataaagctctgcctgccccaattgaaaagactatatccaaagcaaag

SEQ ID NO: 30535 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgggcctagcgtgttcctctttccaccgaagcccaaagacacccttatgatctccagaacacctgaagtcacttgcgttgtggtagatgtgtctcacgaggacccagaagtcaagttcaacgtgtacgttgatggagtggaggtccataatgcaaaaacgaagcccagggaggaacagtataactcaacctaccgggtggtaagtgttctgacagtgttgcaccaagactggttaaatggtaaagagtataagtgtaaggtcagcaacaaagccctgcctgcgccaattgaaaagactatatccaaagctaag

SEQ ID NO: 30536 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgggcctagcgtgttcctctttccaccgaagcccaaagacacccttatgatctccagaacacctgaagtcacttgcgttgtggtagatgtgtctcacgaggacccagaagtcaagttcaacgtgtacgttgatggagtggaggtccataatgcaaaaacgaagcccagggaggaacagtatgcctcaacctaccgggtggtaagtgttctgacagtgttgcaccaagactggttaaacggtaaagagtataagtgtaaggtcagcaataaagcgctgcctgctccaattgaaaagactatatccaaagccaag

SEQ ID NO: 30537 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgggcctagcgtgttcctctttccaccgaagcccaaagacacccttatgatctccagaacacctgaagtcacttgcgttgtggtagatgtgtctcacgaggacccagaagtcaagttcaactggtacgtggatggagttgaggtgcataatgcaaaaacgaagcccagggaggaacagtataactcaacctaccgggtcgtgagtgtactgacagttttgcaccaagactggttaaatggtaaagagtataagtgtaaggtgagcaacaaagccctgcctgcgccaattgaaaagactatatccaaagctaag

SEQ ID NO: 30538 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgggcctagcgtgttcctctttccaccgaagcccaaagacacccttatgatctccagaacacctgaagtcacttgcgttgtggtagatgtgtctcacgaggacccagaagtcaagttcaactggtacgtggatggagttgaggtgcataatgcaaaaacgaagcccagggaggaacagtatgcctcaacctaccgggtcgtgagtgtactgacagttttgcaccaagactggttaaacggtaaagagtataagtgtaaggtgagcaataaagcgctgcctgctccaattgaaaagactatatccaaagccaag

SEQ ID NO: 30539 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgcacctagcgtgttcctctttccaccgaagcccaaagacacccttatgatctccagaacacctgaagtcacttgcgttgtggtagatgtgtctcacgaggacccagaagtcaagttcaacgtgtacgttgatggggtggaggtccataatgccaaaacgaagcccagggaggaacagtataactcaacctaccgggtggtaagtgttctgacagtgttgcaccaagactggttaaatggaaaagagtataagtgtaaggtcagcaacaaagcgctgcctgctccaattgaaaagactatatccaaagccaag

SEQ ID NO: 30540 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgcacctagcgtgttcctctttccaccgaagcccaaagacacccttatgatctccagaacacctgaagtcacttgcgttgtggtagatgtgtctcacgaggacccagaagtcaagttcaacgtgtacgttgatggggtggaggtccataatgccaaaacgaagcccagggaggaacagtatgcgtcaacctaccgggtggtaagtgttctgacagtgttgcaccaagactggttaaacggaaaagagtataagtgtaaggtcagcaataaagctctgcctgccccaattgaaaagactatatccaaagcaaag

SEQ ID NO: 30541 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgcacctagcgtgttcctctttccaccgaagcccaaagacacccttatgatctccagaacacctgaagtcacttgcgttgtggtagatgtgtctcacgaggacccagaagtcaagttcaactggtacgtggatggggttgaggtgcataatgccaaaacgaagcccagggaggaacagtataactcaacctaccgggtcgtgagtgtactgacagttttgcaccaagactggttaaatggaaaagagtataagtgtaaggtgagcaacaaagcgctgcctgctccaattgaaaagactatatccaaagccaag

SEQ ID NO: 30542 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctctgggcgcacctagcgtgttcctctttccaccgaagcccaaagacacccttatgatctccagaacacctgaagtcacttgcgttgtggtagatgtgtctcacgaggacccagaagtcaagttcaactggtacgtggatggggttgaggtgcataatgccaaaacgaagcccagggaggaacagtatgcgtcaacctaccgggtcgtgagtgtactgacagttttgcaccaagactggttaaacggaaaagagtataagtgtaaggtgagcaataaagctctgcctgccccaattgaaaagactatatccaaagcaaag

SEQ ID NO: 30543 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgggcctagcgtgttcctgtttccaccgaagcccaaagacaccctcatgatctccagaacacctgaagtcacttgcgttgtggtagatgtgtctcacgaggacccagaagtcaagttcaacgtgtacgttgatggagtggaggtccataatgccaaaacgaagcccagggaggaacagtataactcaacctaccgggtggtaagtgttcttacagtgctgcaccaagactggttgaatggtaaagagtataagtgtaaggtcagcaacaaagcgttacctgctccaattgaaaagactatatccaaagccaag

SEQ ID NO: 30544 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgggcctagcgtgttcctgtttccaccgaagcccaaagacaccctcatgatctccagaacacctgaagtcacttgcgttgtggtagatgtgtctcacgaggacccagaagtcaagttcaacgtgtacgttgatggagtggaggtccataatgccaaaacgaagcccagggaggaacagtatgcgtcaacctaccgggtggtaagtgttcttacagtgctgcaccaagactggttgaacggtaaagagtataagtgtaaggtcagcaataaagccttacctgctccaattgaaaagactatatccaaagcaaag

SEQ ID NO: 30545 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgggcctagcgtgttcctgtttccaccgaagcccaaagacaccctcatgatctccagaacacctgaagtcacttgcgttgtggtagatgtgtctcacgaggacccagaagtcaagttcaactggtacgtggatggagttgaggtgcataatgccaaaacgaagcccagggaggaacagtataactcaacctaccgggtcgtgagtgtacttacagttctgcaccaagactggttgaatggtaaagagtataagtgtaaggtgagcaacaaagcgttacctgctccaattgaaaagactatatccaaagccaag

SEQ ID NO: 30546 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgggcctagcgtgttcctgtttccaccgaagcccaaagacaccctcatgatctccagaacacctgaagtcacttgcgttgtggtagatgtgtctcacgaggacccagaagtcaagttcaactggtacgtggatggagttgaggtgcataatgccaaaacgaagcccagggaggaacagtatgcgtcaacctaccgggtcgtgagtgtacttacagttctgcaccaagactggttgaacggtaaagagtataagtgtaaggtgagcaataaagccttacctgctccaattgaaaagactatatccaaagcaaag

SEQ ID NO: 30547 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgcccctagcgtgttcctgtttccaccgaagcccaaagacaccctcatgatctccagaacacctgaagtcacttgcgttgtggtagatgtgtctcacgaggacccagaagtcaagttcaacgtgtacgttgatggggtggaggtccataatgcgaaaacgaagcccagggaggaacagtataactcaacctaccgggtggtaagtgttcttacagtgctgcaccaagactggttgaatggaaaagagtataagtgtaaggtcagcaacaaagccttacctgctccaattgaaaagactatatccaaagcaaag

SEQ ID NO: 30548 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgcccctagcgtgttcctgtttccaccgaagcccaaagacaccctcatgatctccagaacacctgaagtcacttgcgttgtggtagatgtgtctcacgaggacccagaagtcaagttcaacgtgtacgttgatggggtggaggtccataatgcgaaaacgaagcccagggaggaacagtatgcttcaacctaccgggtggtaagtgttcttacagtgctgcaccaagactggttgaacggaaaagagtataagtgtaaggtcagcaataaagccttacctgcaccaattgaaaagactatatccaaagccaag

SEQ ID NO: 30549 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgcccctagcgtgttcctgtttccaccgaagcccaaagacaccctcatgatctccagaacacctgaagtcacttgcgttgtggtagatgtgtctcacgaggacccagaagtcaagttcaactggtacgtggatggggttgaggtgcataatgcgaaaacgaagcccagggaggaacagtataactcaacctaccgggtcgtgagtgtacttacagttctgcaccaagactggttgaatggaaaagagtataagtgtaaggtgagcaacaaagccttacctgctccaattgaaaagactatatccaaagcaaag

SEQ ID NO: 30550 - RNA, 330 nt, synthetic construct
  misc_feature 1..330: note = derived and/or modified sequence opt3 from IgG1_HeavyChain_CH2_constant_domain
  source 1..330: mol_type = other RNA
gcccccgaggctgcaggcgcccctagcgtgttcctgtttccaccgaagcccaaagacaccctcatgatctccagaacacctgaagtcacttgcgttgtggtagatgtgtctcacgaggacccagaagtcaagttcaactggtacgtggatggggttgaggtgcataatgcgaaaacgaagcccagggaggaacagtatgcttcaacctaccgggtcgtgagtgtacttacagttctgcaccaagactggttgaacggaaaagagtataagtgtaaggtgagcaataaagccttacctgcaccaattgaaaagactatatccaaagccaag

SEQ ID NO: 30551 - RNA, 318 nt, synthetic construct
  misc_feature 1..318: note = derived and/or modified sequence opt3 from IgG1_HeavyChain_CH3_constant_domain
  source 1..318: mol_type = other RNA
ggccagcccagagagcctcaagtgtacaccctgccaccgagcagggaagagatgacaaagaaccaggtctccctcacttgccttgttaaagggttctatccctctgacatcgccgtggaatgggagtcaaatggacagcctgaaaacaattacaagacgaccccacccgtactggatagtgacggtagctttttcttgtattccaaattaacagtggataagtctcggtggcagcaaggcaacgtcttttcgtgttcagtgatgcacgaggctctgcataatcactacactcagaaaagcctaagtctctcccctggg

SEQ ID NO: 30552 - RNA, 318 nt, synthetic construct
  misc_feature 1..318: note = derived and/or modified sequence opt3 from IgG1_HeavyChain_CH3_constant_domain
  source 1..318: mol_type = other RNA
ggccagcccagagagcctcaagtgtacaccctgccaccgagcagggaggaactcacaaagaaccaggtctcccttacttgcctggttaaagggttctatccctctgacatcgccgtggaatgggagtcaaatggacagcctgaaaacaattacaagacgaccccacccgtattggatagtgacggtagctttttcttatattccaaactgacagtggataagtctcggtggcagcaaggcaacgtcttttcgtgttcagtgatgcacgaggctctacataatcactacactcagaaaagcctcagtctgtcccctggg

SEQ ID NO: 30553 - RNA, 318 nt, synthetic construct
  misc_feature 1..318: note = derived and/or modified sequence opt3 from IgG1_HeavyChain_CH3_constant_domain
  source 1..318: mol_type = other RNA
ggccagcccagagagcctcaagtgtacaccctgccaccgagcagggacgaaatgacaaagaaccaggtctccctcacttgccttgttaaagggttctatccctctgatatcgccgtggagtgggaatcaaatggacagcctgagaacaattacaagacgaccccacccgtactggacagtgatggtagctttttcttgtattccaaattaacagtggacaagtctcggtggcagcaaggcaacgtcttttcgtgttcagtgatgcacgaagctctgcataatcactacactcagaaaagcctaagtctctcccctggg

SEQ ID NO: 30554 - RNA, 318 nt, synthetic construct
  misc_feature 1..318: note = derived and/or modified sequence opt3 from IgG1_HeavyChain_CH3_constant_domain
  source 1..318: mol_type = other RNA
ggccagcccagagagcctcaagtgtacaccctgccaccgagcagggacgaactcacaaagaaccaggtctcccttacttgcctggttaaagggttctatccctctgatatcgccgtggagtgggaatcaaatggacagcctgagaacaattacaagacgaccccacccgtattggacagtgatggtagctttttcttatattccaaactgacagtggacaagtctcggtggcagcaaggcaacgtcttttcgtgttcagtgatgcacgaagctctacataatcactacactcagaaaagcctcagtctgtcccctggg

SEQ ID NO: 30555 - RNA, 297 nt, synthetic construct
  misc_feature 1..297: note = derived and/or modified sequence opt3 from IgG2_HeavyChain_CH1_constant_domain
  source 1..297: mol_type = other RNA
agcgcctccaccaagggcccctctgtgttccctctggctccatgctcaagaagtacaagcgagtccactgcagccctcgggtgtcttgtcaaagactactttccggaacccgttacggtgtcttggaactcgggagcgctgacctcaggtgtacacacattccctgctgtgttgcagagcagtggcttatactccctgtctagcgtcgtgactgttccatcctcaaattttgggacccaaacatatacctgcaacgtggatcataagcccagtaatactaaagtcgacaagacagtg

SEQ ID NO: 30556 - RNA, 297 nt, synthetic construct
  misc_feature 1..297: note = derived and/or modified sequence opt3 from IgG2_HeavyChain_CH1_constant_domain
  source 1..297: mol_type = other RNA
agcgcctccaccaagggcccctctgtgttccctctggctccatgctcaagaagtacaagcgagtccactgcagccctcgggtgtcttgtcaaagactactttccggaacccgttacggtgtcttggaactcgggagcgctgacctcaggtgtacacacattccctgctgtgttgcagagcagtggcttatattccctgtctagcgtcgtgactgttacctcctcaaattttgggacacaaacctacacttgcaacgtggatcataagccaagtaatacaaaagtcgacaagaccgtg

SEQ ID NO: 30557 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatggggtggaagtccataatgcaaagacgaaacctagggaggaacaatttaactcaaccttccgggtggtaagtgttcttacagtggtccaccaggactggctgaatggaaaggagtataaatgtaaggtgagcaacaagggtttgccagcccccattgagaaaactatatccaagaccaaa

SEQ ID NO: 30558 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatggggtggaagtccataatgcaaagacgaaacctagggaggaacaatttaactcaaccttccgggtggtaagtgttcttacagtggtccaccaggactggctgaatggaaaggagtataaatgtaaggtgagcaacaagggtttgccagcctccattgagaaaactatatctaagaccaaa

SEQ ID NO: 30559 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatggggtggaagtccataatgcaaagacgaaacctagggaggaacaatttaactcaaccttccgggtggtaagtgttcttacagtggtccaccaggactggctgaatggaaaggagtataaatgtaaggtgagcaacaagggtttgccatcccccattgagaaaactatatctaagaccaaa

SEQ ID NO: 30560 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatggggtggaagtccataatgcaaagacgaaacctagggaggaacaatttaactcaaccttccgggtggtaagtgttcttacagtggtccaccaggactggctgaatggaaaggagtataaatgtaaggtgagcaacaagggtttgccatcctctattgagaaaactatatcgaagaccaaa

SEQ ID NO: 30561 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatgggatggaagtgcataatgcaaagacgaaacctagggaggaacaatttaactcaaccttccgggtcgtgagtgtacttacagttgtgcaccaggactggctgaatggaaaggagtataaatgtaaggtcagcaacaagggtttgccagcccccattgagaaaactatatccaagaccaaa

SEQ ID NO: 30562 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatgggatggaagtgcataatgcaaagacgaaacctagggaggaacaatttaactcaaccttccgggtcgtgagtgtacttacagttgtgcaccaggactggctgaatggaaaggagtataaatgtaaggtcagcaacaagggtttgccagcctccattgagaaaactatatctaagaccaaa

SEQ ID NO: 30563 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatgggatggaagtgcataatgcaaagacgaaacctagggaggaacaatttaactcaaccttccgggtcgtgagtgtacttacagttgtgcaccaggactggctgaatggaaaggagtataaatgtaaggtcagcaacaagggtttgccatcccccattgagaaaactatatctaagaccaaa

SEQ ID NO: 30564 - RNA, 327 nt, synthetic construct
  misc_feature 1..327: note = derived and/or modified sequence opt3 from IgG2_HeavyChain_CH2_constant_domain
  source 1..327: mol_type = other RNA
gctccccctgtggccggcccaagcgtcttcctgtttccgcccaagcctaaagacaccctcatgatctccagaacaccagaggttacttgcgtggtagtggatgtctctcacgaagaccccgaggtgcagttcaactggtacgttgatgggatggaagtgcataatgcaaagacgaaacctagggaggaacaatttaactcaaccttccgggtcgtgagtgtacttacagttgtgcaccaggactggctgaatggaaaggagtataaatgtaaggtcagcaacaagggtttgccatcctctattgagaaaactatatcgaagaccaaa

SEQ ID NO: 30565 - RNA, 318 nt, synthetic construct
  misc_feature 1..318: note = derived and/or modified sequence opt3 from IgG2_HeavyChain_CH3_constant_domain
  source 1..318: mol_type = other RNA
ggccagcccagagagcctcaagtgtacaccctgccaccgagcagggaagagatgacaaagaaccaggtctccctcacttgccttgttaaagggttctatccctctgacatcgccgtggaatgggagtcaaatggacagcctgaaaacaattacaagacgaccccacccatgctggatagtgacggtagctttttcttgtattccaaattaacagtagataagtctcggtggcagcaaggcaacgtgttttcgtgttcagtcatgcacgaggctctgcataatcactacactcagaaaagcctaagtctctcccctggg

SEQ ID NO: 30566 - RNA, 297 nt, synthetic construct
  misc_feature 1..297: note = derived and/or modified sequence opt3 from IgG4_HeavyChain_CH1_constant_domain
  source 1..297: mol_type = other RNA
agcgcctccaccaagggcccctctgtgttccctctggctccatgctcaagaagtacaagcgagtccactgcagccctcgggtgtcttgtcaaagactactttccggaacccgttacggtgtcttggaactcgggagcgctgacctcaggtgtacacacattccctgctgtgttgcagagcagtggcttatactccctgtctagcgtcgtgactgttccatcctcaagtctagggaccaagacatatacctgcaatgtggatcataaacccagcaacactaaggtcgacaaaagggtg

SEQ ID NO: 30567 - RNA, 330 nt, synthetic construct
  misc_feature 1..330: note = derived and/or modified sequence opt3 from IgG4_HeavyChain_CH2_constant_domain
  source 1..330: mol_type = other RNA
gcccccgagttcctgggcgggcctagcgtgtttctcttcccaccgaagcccaaagacacccttatgatctccagaacacctgaagtcacttgcgttgtggtagatgtgtctcaggaggacccagaagtccaatttaactggtacgtggatggagttgaggtgcacaatgctaagacgaaacccagggaagaacagttcaactcaacctatcgggtcgtgagtgtactgacagttttgcatcaggactggttaaatggtaaggagtacaaatgtaaggtgagcaacaagggcctgccttcctctattgagaaaactatatcgaaggcaaaa

SEQ ID NO: 30568 - RNA, 318 nt, synthetic construct
  misc_feature 1..318: note = derived and/or modified sequence opt3 from IgG4_HeavyChain_CH3_constant_domain
  source 1..318: mol_type = other RNA
ggccagcccagagagcctcaggtgtacaccctgccaccgagccaggaagagatgacaaagaaccaggtctccctcacttgccttgttaaagggttctatccctctgacatcgccgtggaatgggagtcaaatggacagcctgaaaacaattacaagacgaccccacccgtactggatagtgacggtagctttttcttgtattccaggttaacagtggataaatctcggtggcaagagggcaacgtcttttcgtgttcagtgatgcacgaggctctgcataatcactacactcaaaagagcctaagtctctccctgggg

SEQ ID NO: 30569 - RNA, 1347 nt, synthetic construct
  misc_feature 1..1347: note = derived and/or modified sequence opt4 from AAB-003_gamma1-Chain
  source 1..1347: mol_type = other RNA
gaggtgcagctgctggagagcggcggcggcctggtgcagcccggcggcagcctgagactgagctgcgccgccagcggcttcaccttcagcaactacggcatgagctgggtgagacaggcccccggcaagggcctggagtgggtggccagcatcagaagcggcggcggcagaacctactacagcgacaacgtgaagggcagattcaccatcagcagagacaacagcaagaacaccctgtacctgcagatgaacagcctgagagccgaggacaccgccgtgtactactgcgtgagatacgaccactacagcggcagcagcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30570 - RNA, 1329 nt, synthetic construct
  misc_feature 1..1329: note = derived and/or modified sequence opt4 from Abagovomab_HeavyChain
  source 1..1329: mol_type = other RNA
caggtgaagctgcaggagagcggcgccgagctggccagacccggcgccagcgtgaagctgagctgcaaggccagcggctacaccttcaccaactactggatgcagtgggtgaagcagagacccggccagggcctggactggatcggcgccatctaccccggcgacggcaacaccagatacacccacaagttcaagggcaaggccaccctgaccgccgacaagagcagcagcaccgcctacatgcagctgagcagcctggccagcgaggacagcggcgtgtactactgcgccagaggcgagggcaactacgcctggttcgcctactggggccagggcaccaccgtgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctggttcgtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatggacaccgacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 30571 - RNA, 642 nt, synthetic construct
  misc_feature 1..642: note = derived and/or modified sequence opt4 from Abagovomab_LightChain
  source 1..642: mol_type = other RNA
gacatcgagctgacccagagccccgccagcctgagcgccagcgtgggcgagaccgtgaccatcacctgccaggccagcgagaacatctacagctacctggcctggcaccagcagaagcagggcaagagcccccagctgctggtgtacaacgccaagaccctggccggcggcgtgagcagcagattcagcggcagcggcagcggcacccacttcagcctgaagatcaagagcctgcagcccgaggacttcggcatctactactgccagcaccactacggcatcctgcccaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 30572 - RNA, 1350 nt, synthetic construct
  misc_feature 1..1350: note = derived and/or modified sequence opt4 from Abciximab_HeavyChain
  source 1..1350: mol_type = other RNA
gaggtgcagctgcagcagagcggcgccgagctggtgaagcccggcgccagcgtgaagctgagctgcaccgccagcggcttcaacatcaaggacacctacgtgcactgggtgaagcagagacccgagcagggcctggagtggatcggcagaatcgaccccgccaacggctacaccaagtacgaccccaagttccagggcaaggccaccatcaccgccgacaccagcagcaacaccgcctacctgcagctgagcagcctgaccagcgaggacaccgccgtgtactactgcgtgagacccctgtacgactactacgccatggactactggggccagggcaccagcgtgaccgtgagcagcgccaagaccaccgcccccagcgtgtaccccctggcccccgtgtgcggcgacaccaccggcagcagcgtgaccctgggctgcctggtgaagggctacttccccgagcccgtgaccctgacctggaacagcggcagcctgagcagcggcgtgcacaccttccccgccgtgctgcagagcgacctgtacaccctgagcagcagcgtgaccgtgaccagcagcacctggcccagccagagcatcacctgcaacgtggcccaccccgccagcagcaccaaggtggacaagaagatcgagcccagacccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30573 - RNA, 642 nt, synthetic construct
  misc_feature 1..642: note = derived and/or modified sequence opt4 from Abciximab_LightChain
  source 1..642: mol_type = other RNA
gacatcctgatgacccagagccccagcagcatgagcgtgagcctgggcgacaccgtgagcatcacctgccacgccagccagggcatcagcagcaacatcggctggctgcagcagaagcccggcaagagcttcatgggcctgatctactacggcaccaacctggtggacggcgtgcccagcagattcagcggcagcggcagcggcgccgactacagcctgaccatcagcagcctggacagcgaggacttcgccgactactactgcgtgcagtacgcccagctgccctacaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 30574 - RNA, 1341 nt, synthetic construct
  misc_feature 1..1341: note = derived and/or modified sequence opt4 from Abituzumab_HeavyChain1
  source 1..1341: mol_type = other RNA
caggtgcagctgcagcagagcggcggcgagctggccaagcccggcgccagcgtgaaggtgagctgcaaggccagcggctacaccttcagcagcttctggatgcactgggtgagacaggcccccggccagggcctggagtggatcggctacatcaaccccagaagcggctacaccgagtacaacgagatcttcagagacaaggccaccatgaccaccgacaccagcaccagcaccgcctacatggagctgagcagcctgagaagcgaggacaccgccgtgtactactgcgccagcttcctgggcagaggcgccatggactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagcccaagagcagcgacaagacccacacctgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcaggcccagagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30575 - RNA, 642 nt, synthetic construct
  misc_feature 1..642: note = derived and/or modified sequence opt4 from Abituzumab_LightChain1
  source 1..642: mol_type = other RNA
gacatccagatgacccagagccccagcagcctgagcgccagcgtgggcgacagagtgaccatcacctgcagagccagccaggacatcagcaactacctggcctggtaccagcagaagcccggcaaggcccccaagctgctgatctactacaccagcaagatccacagcggcgtgcccagcagattcagcggcagcggcagcggcaccgactacaccttcaccatcagcagcctgcagcccgaggacatcgccacctactactgccagcagggcaacaccttcccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30576 - RNA, 1332 nt, synthetic construct
  misc_feature 1..1332: note = derived and/or modified sequence opt4 from Abrilumab_HeavyChain1
  source 1..1332: mol_type = other RNA
caggtgcagctggtgcagagcggcgccgaggtgaagaagcccggcgccagcgtgaaggtgagctgcaaggtgagcggctacaccctgagcgacctgagcatccactgggtgagacaggcccccggcaagggcctggagtggatgggcggcttcgacccccaggacggcgagaccatctacgcccagaagttccagggcagagtgaccatgaccgaggacaccagcaccgacaccgcctacatggagctgagcagcctgaagagcgaggacaccgccgtgtactactgcgccaccggcagcagcagcagctggttcgacccctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30577 - RNA, 642 nt, synthetic construct
  misc_feature 1..642: note = derived and/or modified sequence opt4 from Abrilumab_LightChain1
  source 1..642: mol_type = other RNA
gacatccagatgacccagagccccagcagcgtgagcgccagcgtgggcgacagagtgaccatcacctgcagagccagccagggcatcagcagctggctggcctggtaccagcagaagcccggcaaggcccccaagctgctgatctacggcgccagcaacctggagagcggcgtgcccagcagattcagcggcagcggcagcggcaccgacttcaccctgaccatcagcagcctgcagcccgaggacttcgccaactactactgccagcaggccaacagcttcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30578 - RNA, 639 nt, synthetic construct
  misc_feature 1..639: note = derived and/or modified sequence opt4 from Abrilumab_LightChain1_variant2
  source 1..639: mol_type = other RNA
cagatcgtgctgacccagagccccgccatcatgagcgccagccccggcgagaaggtgaccatcacctgcagcgccagcagcagcgtgagctacatgaactggttccagcagaagcccggcaccagccccaagctgtggatctacagcaccagcaacctggccagcggcgtgcccgccagattcagcggcagcggcagcggcaccagctacagcctgaccatcagcagaatggaggccgaggacgccgccacctactactgccagcagagaagcagctaccccaacaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 30579 - RNA, 1347 nt, synthetic construct
  misc_feature 1..1347: note = derived and/or modified sequence opt4 from Actoxumab_HeavyChain1
  source 1..1347: mol_type = other RNA
gaggtgcagctggtgcagagcggcgccgaggtgaagaagagcggcgagagcctgaagatcagctgcaagggcagcggctacagcttcaccagctactggatcggctgggtgagacagatgcccggcaagggcctggagtggatgggcatcttctaccccggcgacagcagcaccagatacagccccagcttccagggccaggtgaccatcagcgccgacaagagcgtgaacaccgcctacctgcagtggagcagcctgaaggccagcgacaccgccatgtactactgcgccagaagaagaaactggggcaacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30580 - RNA, 645 nt, synthetic construct
  misc_feature 1..645: note = derived and/or modified sequence opt4 from Actoxumab_LightChain1
  source 1..645: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcacctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30581 - RNA, 672 nt, synthetic construct
  misc_feature 1..672: note = derived and/or modified sequence opt4 from Adalimumab_HeavyChain
  source 1..672: mol_type = other RNA
gaggtgcagctggtggagagcggcggcggcctggtgcagcccggcagaagcctgagactgagctgcgccgccagcggcttcaccttcgacgactacgccatgcactgggtgagacaggcccccggcaagggcctggagtgggtgagcgccatcacctggaacagcggccacatcgactacgccgacagcgtggagggcagattcaccatcagcagagacaacgccaagaacagcctgtacctgcagatgaacagcctgagagccgaggacaccgccgtgtactactgcgccaaggtgagctacctgagcaccgccagcagcctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 30582 - RNA, 642 nt, synthetic construct
  misc_feature 1..642: note = derived and/or modified sequence opt4 from Adalimumab_LightChain
  source 1..642: mol_type = other RNA
gacatccagatgacccagagccccagcagcctgagcgccagcgtgggcgacagagtgaccatcacctgcagagccagccagggcatcagaaactacctggcctggtaccagcagaagcccggcaaggcccccaagctgctgatctacgccgccagcaccctgcagagcggcgtgcccagcagattcagcggcagcggcagcggcaccgacttcaccctgaccatcagcagcctgcagcccgaggacgtggccacctactactgccagagatacaacagagccccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30583 - RNA, 1359 nt, synthetic construct
  misc_feature 1..1359: note = derived and/or modified sequence opt4 from Aducanumab_HeavyChain1
  source 1..1359: mol_type = other RNA
caggtgcagctggtggagagcggcggcggcgtggtgcagcccggcagaagcctgagactgagctgcgccgccagcggcttcgccttcagcagctacggcatgcactgggtgagacaggcccccggcaagggcctggagtgggtggccgtgatctggttcgacggcaccaagaagtactacaccgacagcgtgaagggcagattcaccatcagcagagacaacagcaagaacaccctgtacctgcagatgaacaccctgagagccgaggacaccgccgtgtactactgcgccagagacagaggcatcggcgccagaagaggcccctactacatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30584 - RNA, 642 nt, synthetic construct
  misc_feature 1..642: note = derived and/or modified sequence opt4 from Aducanumab_LightChain1
  source 1..642: mol_type = other RNA
gacatccagatgacccagagccccagcagcctgagcgccagcgtgggcgacagagtgaccatcacctgcagagccagccagagcatcagcagctacctgaactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagctacagcacccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30585 - RNA, 1359 nt, synthetic construct
  misc_feature 1..1359: note = derived and/or modified sequence opt4 from Afasevikumab_HeavyChain1
  source 1..1359: mol_type = other RNA
gaggtgcagctggtggagagcggcggcggcctggtgcagcccggcagaagcctgagactgagctgcgccgccagcggcttcaccttcgacgactacgccatgcactgggtgagacaggcccccggcaagggcctggagtgggtgagcggcatcaactggagcagcggcggcatcggctacgccgacagcgtgaagggcagattcaccatcagcagagacaacgccaagaacagcctgtacctgcagatgaacagcctgagagccgaggacaccgccctgtactactgcgccagagacatcggcggcttcggcgagttctactggaacttcggcctgtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30586 - RNA, 645 nt, synthetic construct
  misc_feature 1..645: note = derived and/or modified sequence opt4 from Afasevikumab_LightChain1
  source 1..645: mol_type = other RNA
gagatcgtgctgacccagagccccgccaccctgagcctgagccccggcgagagagccaccctgagctgcagagccagccagagcgtgagaagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccgccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30587 - RNA, 1293 nt, synthetic construct
  misc_feature 1..1293: note = derived and/or modified sequence opt4 from Aflibercept_Fusion_protein1
  source 1..1293: mol_type = other RNA
agcgacaccggcagacccttcgtggagatgtacagcgagatccccgagatcatccacatgaccgagggcagagagctggtgatcccctgcagagtgaccagccccaacatcaccgtgaccctgaagaagttccccctggacaccctgatccccgacggcaagagaatcatctgggacagcagaaagggcttcatcatcagcaacgccacctacaaggagatcggcctgctgacctgcgaggccaccgtgaacggccacctgtacaagaccaactacctgacccacagacagaccaacaccatcatcgacgtggtgctgagccccagccacggcatcgagctgagcgtgggcgagaagctggtgctgaactgcaccgccagaaccgagctgaacgtgggcatcgacttcaactgggagtaccccagcagcaagcaccagcacaagaagctggtgaacagagacctgaagacccagagcggcagcgagatgaagaagttcctgagcaccctgaccatcgacggcgtgaccagaagcgaccagggcctgtacacctgcgccgccagcagcggcctgatgaccaagaagaacagcaccttcgtgagagtgcacgagaaggacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30588 - RNA, 1332 nt, synthetic construct
  misc_feature 1..1332: note = derived and/or modified sequence opt4 from Afutuzuab_HeavyChain1
  source 1..1332: mol_type = other RNA
caggtgcagctggtgcagagcggcgccgaggtgaagaagcccggcagcagcgtgaaggtgagctgcaaggccagcggctacgccttcagctacagctggatcaactgggtgagacaggcccccggccagggcctggagtggggcagaatcttccccggcgacggcgacaccgactacaacggcaagttcaagggcagagtgaccatcaccgccgacaagagcaccagcaccgcctacgagctgagcagcctgagaagcgaggacaccgccgtgtactactgcgccagaaacgtgttcgacggctactggctggtgtactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 30589 - RNA, 651 nt, synthetic construct
  misc_feature 1..651: note = derived and/or modified sequence opt4 from Afutuzuab_LightChain1
  source 1..651: mol_type = other RNA
gacatcgtgacccagacccccctgagcctgcccgtgacccccggcgagcccgccagcatcagctgcagaagcagcaagagcctgctgcacagcaacggcatcacctacctgtactggtacctgcagaagcccggccagagcccccagctgctgatctaccagagcaacctggtgagcggcgtgcccgacagattcagcggcagcggcagcggcaccgacttcaccctgaagatcagcagagtggaggccgaggacgtgggcgtgtactactgcgcccagaacctggagctgccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30590 - RNA, 1347 nt, synthetic construct
  misc_feature 1..1347: note = derived and/or modified sequence opt4 from Afutuzumab_HeavyChain1
  source 1..1347: mol_type = other RNA
caggtgcagctggtgcagagcggcgccgaggtgaagaagcccggcagcagcgtgaaggtgagctgcaaggccagcggctacgccttcagctacagctggatcaactgggtgagacaggcccccggccagggcctggagtggatgggcagaatcttccccggcgacggcgacaccgactacaacggcaagttcaagggcagagtgaccatcaccgccgacaagagcaccagcaccgcctacatggagctgagcagcctgagaagcgaggacaccgccgtgtactactgcgccagaaacgtgttcgacggctactggctggtgtactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30591 - RNA, 657 nt, synthetic construct
  misc_feature 1..657: note = derived and/or modified sequence opt4 from Afutuzumab_LightChain1
  source 1..657: mol_type = other RNA
gacatcgtgatgacccagacccccctgagcctgcccgtgacccccggcgagcccgccagcatcagctgcagaagcagcaagagcctgctgcacagcaacggcatcacctacctgtactggtacctgcagaagcccggccagagcccccagctgctgatctaccagatgagcaacctggtgagcggcgtgcccgacagattcagcggcagcggcagcggcaccgacttcaccctgaagatcagcagagtggaggccgaggacgtgggcgtgtactactgcgcccagaacctggagctgccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30592 - RNA, 684 nt, synthetic construct
  misc_feature 1..684: note = derived and/or modified sequence opt4 from Alacizumab_pegol_HeavyChain1
  source 1..684: mol_type = other RNA
gaggtgcagctggtggagagcggcggcggcctggtgcagcccggcggcagcctgagactgagctgcgccgccagcggcttcaccttcagcagctacggcatgagctgggtgagacaggcccccggcaagggcctggagtgggtggccaccatcaccagcggcggcagctacacctactacgtggacagcgtgaagggcagattcaccatcagcagagacaacgccaagaacaccctgtacctgcagatgaacagcctgagagccgaggacaccgccgtgtactactgcgtgagaatcggcgaggacgccctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgcgccgcc

SEQ ID NO: 30593 - RNA, 642 nt, synthetic construct
  misc_feature 1..642: note = derived and/or modified sequence opt4 from Alacizumab_pegol_LightChain1
  source 1..642: mol_type = other RNA
gacatccagatgacccagagccccagcagcctgagcgccagcgtgggcgacagagtgaccatcacctgcagagccagccaggacatcgccggcagcctgaactggctgcagcagaagcccggcaaggccatcaagagactgatctacgccaccagcagcctggacagcggcgtgcccaagagattcagcggcagcagaagcggcagcgactacaccctgaccatcagcagcctgcagcccgaggacttcgccacctactactgcctgcagtacggcagcttcccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30594 - RNA, 1353 nt, synthetic construct
  misc_feature 1..1353: note = derived and/or modified sequence opt4 from Alemtuzumab_HeavyChain
  source 1..1353: mol_type = other RNA
caggtgcagctgcaggagagcggccccggcctggtgagacccagccagaccctgagcctgacctgcaccgtgagcggcttcaccttcaccgacttctacatgaactgggtgagacagccccccggcagaggcctggagtggatcggcttcatcagagacaaggccaagggctacaccaccgagtacaaccccagcgtgaagggcagagtgaccatgctggtggacaccagcaagaaccagttcagcctgagactgagcagcgtgaccgccgccgacaccgccgtgtactactgcgccagagagggccacaccgccgcccccttcgactactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30595 - RNA, 657 nt, synthetic construct
  misc_feature 1..657: note = derived and/or modified sequence opt4 from Alemtuzumab_HeavyChain_variant_1bey_H
  source 1..657: mol_type = other RNA
caggtgcagctgcaggagagcggccccggcctggtgagacccagccagaccctgagcctgacctgcaccgtgagcggcttcaccttcaccgacttctacatgaactgggtgagacagccccccggcagaggcctggagtggatcggcttcatcagagacaaggccaagggctacaccaccgagtacaaccccagcgtgaagggcagagtgaccatgctggtggacaccagcaagaaccagttcagcctgagactgagcagcgtgaccgccgccgacaccgccgtgtactactgcgccagagagggccacaccgccgcccccttcgactactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtg

SEQ ID NO: 30596 - RNA, 660 nt, synthetic construct
  misc_feature 1..660: note = derived and/or modified sequence opt4 from Alemtuzumab_HeavyChain_variant_1ce1_H
  source 1..660: mol_type = other RNA
caggtgcagctgcaggagagcggccccggcctggtgagacccagccagaccctgagcctgacctgcaccgtgagcggcttcaccttcaccgacttctacatgaactgggtgagacagccccccggcagaggcctggagtggatcggcttcatcagagacaaggccaagggctacaccaccgagtacaaccccagcgtgaagggcagagtgaccatgctggtggacaccagcaagaaccagttcagcctgagactgagcagcgtgaccgccgccgacaccgccgtgtactactgcgccagagagggccacaccgccgcccccttcgactactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggag

SEQ ID NO: 30597 - RNA, 1311 nt, synthetic construct
  misc_feature 1..1311: note = derived and/or modified sequence opt4 from Alemtuzumab_HeavyChain_variant_8005_H
  source 1..1311: mol_type = other RNA
caggtgcagctgcaggagagcggccccggcctggtgagacccagccagaccctgagcctgacctgcaccgtgagcggcttcaccttcaccgacttctacatgaactgggtgagacagccccccggcagaggcctggagtggatcggcttcatcagagacaaggccaagggctacaccaccgagtacaaccccagcgtgaagggcagagtgaccatgctggtggacaccagcaagaaccagttcagcctgagactgagcagcgtgaccgccgccgacaccgccgtgtactactgcgccagagagggccacaccgccgcccccttcgactactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggaggcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30598 - RNA, 633 nt, synthetic construct
  misc_feature 1..633: note = derived and/or modified sequence opt4 from Alemtuzumab_LightChain
  source 1..633: mol_type = other RNA
gacatccagatgacccagagccccagcagcctgagcgccagcgtgggcgacagagtgaccatcacctgcaaggccagccagaacatcgacaagtacctgaactggtaccagcagaagcccggcaaggcccccaagctgctgatctacaacaccaacaacctgcagaccggcgtgcccagcagattcagcggcagcggcagcggcaccgacttcaccttcaccatcagcagcctgcagcccgaggacatcgccacctactactgcctgcagcacatcagcagacccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 30599 - RNA, 642 nt, synthetic construct
  misc_feature 1..642: note = derived and/or modified sequence opt4 from Alemtuzumab_LightChain_variant_8005_L
  source 1..642: mol_type = other RNA
gacatccagatgacccagagccccagcagcctgagcgccagcgtgggcgacagagtgaccatcacctgcaaggccagccagaacatcgacaagtacctgaactggtaccagcagaagcccggcaaggcccccaagctgctgatctacaacaccaacaacctgcagaccggcgtgcccagcagattcagcggcagcggcagcggcaccgacttcaccttcaccatcagcagcctgcagcccgaggacatcgccacctactactgcctgcagcacatcagcagacccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30600 - RNA, 1341 nt, synthetic construct
  misc_feature 1..1341: note = derived and/or modified sequence opt4 from Alirocumab_HeavyChain1
  source 1..1341: mol_type = other RNA
gaggtgcagctggtggagagcggcggcggcctggtgcagcccggcggcagcctgagactgagctgcgccgccagcggcttcaccttcaacaactacgccatgaactgggtgagacaggcccccggcaagggcctggactgggtgagcaccatcagcggcagcggcggcaccaccaactacgccgacagcgtgaagggcagattcatcatcagcagagacagcagcaagcacaccctgtacctgcagatgaacagcctgagagccgaggacaccgccgtgtactactgcgccaaggacagcaactggggcaacttcgacctgtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30601 - RNA, 660 nt, synthetic construct
  misc_feature 1..660: note = derived and/or modified sequence opt4 from Alirocumab_LightChain1
  source 1..660: mol_type = other RNA
gacatcgtgatgacccagagccccgacagcctggccgtgagcctgggcgagagagccaccatcaactgcaagagcagccagagcgtgctgtacagaagcaacaacagaaacttcctgggctggtaccagcagaagcccggccagccccccaacctgctgatctactgggccagcaccagagagagcggcgtgcccgacagattcagcggcagcggcagcggcaccgacttcaccctgaccatcagcagcctgcaggccgaggacgtggccgtgtactactgccagcagtactacaccaccccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30602 - RNA, 735 nt, synthetic construct
  misc_feature 1..735: note = derived and/or modified sequence opt4 from ALX-0061_HeavyChain1
  source 1..735: mol_type = other RNA
gaggtgcagctggtggagagcggcggcggcctggtgcagcccggcggcagcctgagactgagctgcgccgccagcggcagcgtgttcaagatcaacgtgatggcctggtacagacaggcccccggcaagggcagagagctggtggccggcatcatcagcggcggcagcaccagctacgccgacagcgtgaagggcagattcaccatcagcagagacaacgccaagaacaccctgtacctgcagatgaacagcctgagacccgaggacaccgccgtgtactactgcgccttcatcaccaccgagagcgactacgacctgggcagaagatactggggccagggcaccctggtgaccgtgagcagcggcggcggcggcagcggcggcggcagcgaggtgcagctggtggagagcggcggcggcctggtgcagcccggcaacagcctgagactgagctgcgccgccagcggcttcaccttcagcagcttcggcatgagctgggtgagacaggcccccggcaagggcctggagtgggtgagcagcatcagcggcagcggcagcgacaccctgtacgccgacagcgtgaagggcagattcaccatcagcagagacaacgccaagaccaccctgtacctgcagatgaacagcctgagacccgaggacaccgccgtgtactactgcaccatcggcggcagcctgagcagaagcagccagggcaccctggtgaccgtgagcagc

SEQ ID NO: 30603 - RNA, 1347 nt, synthetic construct
  misc_feature 1..1347: note = derived and/or modified sequence opt4 from Amatuximab_HeavyChain1
  source 1..1347: mol_type = other RNA
caggtgcagctgcagcagagcggccccgagctggagaagcccggcgccagcgtgaagatcagctgcaaggccagcggctacagcttcaccggctacaccatgaactgggtgaagcagagccacggcaagagcctggagtggatcggcctgatcaccccctacaacggcgccagcagctacaaccagaagttcagaggcaaggccaccctgaccgtggacaagagcagcagcaccgcctacatggacctgctgagcctgaccagcgaggacagcgccgtgtacttctgcgccagaggcggctacgacggcagaggcttcgactactggggcagcggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30604 - RNA, 639 nt, synthetic construct
  misc_feature 1..639: note = derived and/or modified sequence opt4 from Amatuximab_LightChain1
  source 1..639: mol_type = other RNA
gacatcgagctgacccagagccccgccatcatgagcgccagccccggcgagaaggtgaccatgacctgcagcgccagcagcagcgtgagctacatgcactggtaccagcagaagagcggcaccagccccaagagatggatctacgacaccagcaagctggccagcggcgtgcccggcagattcagcggcagcggcagcggcaacagctacagcctgaccatcagcagcgtggaggccgaggacgacgccacctactactgccagcagtggagcaagcaccccctgaccttcggcagcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30605 - RNA, 1350 nt, synthetic construct
  misc_feature 1..1350: note = derived and/or modified sequence opt4 from Anetumab_ravtansine_HeavyChain1
  source 1..1350: mol_type = other RNA
caggtggagctggtgcagagcggcgccgaggtgaagaagcccggcgagagcctgaagatcagctgcaagggcagcggctacagcttcaccagctactggatcggctgggtgagacaggcccccggcaagggcctggagtggatgggcatcatcgaccccggcgacagcagaaccagatacagccccagcttccagggccaggtgaccatcagcgccgacaagagcatcagcaccgcctacctgcagtggagcagcctgaaggccagcgacaccgccatgtactactgcgccagaggccagctgtacggcggcacctacatggacggctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30606 - RNA, 651 nt, synthetic construct
  misc_feature 1..651: note = derived and/or modified sequence opt4 from Anetumab_ravtansine_LightChain1
  source 1..651: mol_type = other RNA
gacatcgccctgacccagcccgccagcgtgagcggcagccccggccagagcatcaccatcagctgcaccggcaccagcagcgacatcggcggctacaacagcgtgagctggtaccagcagcaccccggcaaggcccccaagctgatgatctacggcgtgaacaacagacccagcggcgtgagcaacagattcagcggcagcaagagcggcaacaccgccagcctgaccatcagcggcctgcaggccgaggacgaggccgactactactgcagcagctacgacatcgagagcgccacccccgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaagggcgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30607 - RNA, 1341 nt, synthetic construct
  misc_feature 1..1341: note = derived and/or modified sequence opt4 from Anifrolumab_HeavyChain1
  source 1..1341: mol_type = other RNA
gaggtgcagctggtgcagagcggcgccgaggtgaagaagcccggcgagagcctgaagatcagctgcaagggcagcggctacatcttcaccaactactggatcgcctgggtgagacagatgcccggcaagggcctggagagcatgggcatcatctaccccggcgacagcgacatcagatacagccccagcttccagggccaggtgaccatcagcgccgacaagagcatcaccaccgcctacctgcagtggagcagcctgaaggccagcgacaccgccatgtactactgcgccagacacgacatcgagggcttcgactactggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagttcgagggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgccagcatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30608 - RNA, 645 nt, synthetic construct
  misc_feature 1..645: note = derived and/or modified sequence opt4 from Anifrolumab_LightChain1
  source 1..645: mol_type = other RNA
gagatcgtgctgacccagagccccggcaccctgagcctgagccccggcgagagagccaccctgagctgcagagccagccagagcgtgagcagcagcttcttcgcctggtaccagcagaagcccggccaggcccccagactgctgatctacggcgccagcagcagagccaccggcatccccgacagactgagcggcagcggcagcggcaccgacttcaccctgaccatcaccagactggagcccgaggacttcgccgtgtactactgccagcagtacgacagcagcgccatcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30609 - RNA, 1344 nt, synthetic construct
  misc_feature 1..1344: note = derived and/or modified sequence opt4 from Anrukinzumab_HeavyChain1
  source 1..1344: mol_type = other RNA
gaggtgcagctggtggagagcggcggcggcctggtgcagcccggcggcagcctgagactgagctgcgccgccagcggcttcaccttcatcagctacgccatgagctgggtgagacaggcccccggcaagggcctggagtgggtggccagcatcagcagcggcggcaacacctactaccccgacagcgtgaagggcagattcaccatcagcagagacaacgccaagaacagcctgtacctgcagatgaacagcctgagagccgaggacaccgccgtgtactactgcgccagactggacggctactacttcggcttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccctgggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30610 - RNA, 654 nt, synthetic construct
  misc_feature 1..654: note = derived and/or modified sequence opt4 from Anrukinzumab_LightChain1
  source 1..654: mol_type = other RNA
gacatccagatgacccagagccccagcagcctgagcgccagcgtgggcgacagagtgaccatcacctgcaaggccagcgagagcgtggacaactacggcaagagcctgatgcactggtaccagcagaagcccggcaaggcccccaagctgctgatctacagagccagcaacctggagagcggcgtgcccagcagattcagcggcagcggcagcggcaccgacttcaccctgaccatcagcagcctgcagcccgaggacttcgccacctactactgccagcagagcaacgaggacccctggaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30611 - RNA, 1338 nt, synthetic construct
  misc_feature 1..1338: note = derived and/or modified sequence opt4 from Apolizumab_HeavyChain1
  source 1..1338: mol_type = other RNA
caggtgcagctgcaggagagcggccccggcctggtgaagcccagcgagaccctgagcctgacctgcaccgtgagcggcttcagcctgaccaactacggcgtgcactgggtgagacagagccccggcaagggcctggagtggatcggcgtgaagtggagcggcggcagcaccgagtacaacgccgccttcatcagcagactgaccatcagcaaggacaccagcaagaaccaggtgagcctgaagctgaacagcctgaccgccgccgacaccgccgtgtactactgcgccagaaacgacagatacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30612 - RNA, 642 nt, synthetic construct
  misc_feature 1..642: note = derived and/or modified sequence opt4 from Apolizumab_LightChain1
  source 1..642: mol_type = other RNA
gacatccagatgacccagagccccagcagcctgagcgccagcgtgggcgacagagtgaccatcacctgcagagccagcgagaacatctacagctacctggcctggtaccagcagaagcccggcaaggcccccaagctgctggtgagcaacgccaagaccctggccgagggcgtgcccagcagattcagcggcagcggcagcggcaagcagttcaccctgaccatcagcagcctgcagcccgaggacttcgccacctactactgccagcaccactacggcaacagctaccccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30613 - RNA, 378 nt, synthetic construct
  misc_feature 1..378: note = derived and/or modified sequence opt4 from Apomab_HeavyChain
  source 1..378: mol_type = other RNA
gaggtgcagctggtgcagagcggcggcggcgtggagagacccggcggcagcctgagactgagctgcgccgccagcggcttcaccttcgacgactacgccatgtgggtgagacaggcccccggcaagggcctggagtgggtgagcggcatcaactggcagggcggcagcaccggctacgccgacagcgtgaagggcagagtgaccatcagcagagacaacgccaagaacagcctgtacctgcagatgaacagcctgagagccgaggacaccgccgtgtactactgcgccaagatcctgggcgccggcagaggctggtacttcgactactggggcaagggcaccaccgtgaccgtgagcagcgccagcaccaagggcccc

SEQ ID NO: 30614 - RNA, 324 nt, synthetic construct
  misc_feature 1..324: note = derived and/or modified sequence opt4 from Apomab_LightChain
  source 1..324: mol_type = other RNA
agcgagctgacccaggaccccgccgtgagcgtggccctgggccagaccgtgagaatcacctgcagcggcgacagcctgagaagctactacgccagctggtaccagcagaagcccggccaggcccccgtgctggtgatctacggcgccaacaacagacccagcggcatccccgacagattcagcggcagcagcagcggcaacaccgccagcctgaccatcaccggcgcccaggccgaggacgaggccgactactactgcaacagcgccgacagcagcggcaaccacgtggtgttcggcggcggcaccaagctgaccgtgctgggc

SEQ ID NO: 30615 - RNA, 645 nt, synthetic construct
  misc_feature 1..645: note = derived and/or modified sequence opt4 from Aquaporumab_LightChain
  source 1..645: mol_type = other RNA
gagatcgtgctgacccagagccccggcaccctgagcctgagccccggcgagagagccaccctgagctgcagagccagccagaccgtgagaaccaactacctggcctggttccagcagaagcccggccaggcccccagactgctgatcttcggcgccagcagcagagccaccggcatccccgacagattcagcggcagcggcagcggcaccgacttcaccctgaccatcagcagactggagcccgaggacttcgccgtgtactactgccagcagtacggcagcagcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30616 - RNA, 1326 nt, synthetic construct
  misc_feature 1..1326: note = derived and/or modified sequence opt4 from Arcitumomab_99tc_HeavyChain
  source 1..1326: mol_type = other RNA
gaggtgaagctggtggagagcggcggcggcctggtgcagcccggcggcagcctgagactgagctgcgccaccagcggcttcaccttcaccgactactacatgaactgggtgagacagccccccggcaaggccctggagtggctgggcttcatcggcaacaaggccaacggctacaccaccgagtacagcgccagcgtgaagggcagattcaccatcagcagagacaagagccagagcatcctgtacctgcagatgaacaccctgagagccgaggacagcgccacctactactgcaccagagacagaggcctgagattctacttcgactactggggccagggcaccaccctgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagccccagacccagcgagaccgtgacctgcaacgtggcccaccccgccagcagcaccaaggtggacaagaagatcgtgcccagagactgccccccctgcaagtgccccgcccccaacctgctgggcggccccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccacagagaggactacaacagcaccctgagagtggtgagcgccctgcccatccagcaccaggactggatgagcggcaaggagttcaagtgcaaggtgaacaacaaggacctgcccgcccccatcgagagaaccatcagcaagcccaagggcagcgtgagagccccccaggtgtacgtgctgcccccccccgaggaggagatgaccaagaagcaggtgaccctgacctgcatggtgaccgacttcatgcccgaggacatctacgtggagtggaccaacaacggcaagaccgagctgaactacaagaacaccgagcccgtgctggacagcgacggcagctacttcatgtacagcaagctgagagtggagaagaagaactgggtggagagaaacagctacagctgcagcgtggtgcacgagggcctgcacaaccaccacaccaccaagagcttcagcaga

SEQ ID NO: 30617 - RNA, 639 nt, synthetic construct
  misc_feature 1..639: note = derived and/or modified sequence opt4 from Arcitumomab_99tc_LightChain
  source 1..639: mol_type = other RNA
cagaccgtgctgagccagagccccgccatcctgagcgccagccccggcgagaaggtgaccatgacctgcagagccagcagcagcgtgacctacatccactggtaccagcagaagcccggcagcagccccaagagctggatctacgccaccagcaacctggccagcggcgtgcccgccagattcagcggcagcggcagcggcaccagctacagcctgaccatcagcagagtggaggccgaggacgccgccacctactactgccagcactggagcagcaagccccccaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 30618 - RNA, 1329 nt, synthetic construct
  misc_feature 1..1329: note = derived and/or modified sequence opt4 from Ascrinvacumab_HeavyChain1
  source 1..1329: mol_type = other RNA
caggtgcagctgcaggagagcggccccggcctggtgaagcccagccagaccctgagcctgacctgcaccgtgagcggcggcagcatcagcagcggcgagtactactggaactggatcagacagcaccccggcaagggcctggagtggatcggctacatctactacagcggcagcacctactacaaccccagcctgaagagcagagtgaccatcagcgtggacaccagcaagaaccagttcagcctgaagctgagcagcgtgaccgccgccgacaccgccgtgtactactgcgccagagagagcgtggccggcttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30619 - RNA, 645 nt, synthetic construct
  misc_feature 1..645: note = derived and/or modified sequence opt4 from Ascrinvacumab_LightChain1
  source 1..645: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcaccagcagcagagccaccggcatccccgacagattcagcggcagcggcagcggcaccgacttcaccctgaccatcagcagactggagcccgaggacttcgccgtgtactactgccagcagtacggcagcagccccatcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30620 - RNA, 1314 nt, synthetic construct
  misc_feature 1..1314: note = derived and/or modified sequence opt4 from Aselizuab_HeavyChain1
  source 1..1314: mol_type = other RNA
gaggtgcagctggtggagagcggcggcggcctggtgcagcccggcggcagcctgagactgagctgcgccgccagcggcttcaccttcagcacctacgccagctgggtgagacaggcccccggcaagggcctggagtgggtggccagcatcagcaccggcggcagcacctactaccccgacagcgtgaagggcagattcaccatcagcagagacaacgccaagaacaccctgtacctgcagaacagcctgagagccgaggacaccgccgtgtactactgcgccagagactacgacggctacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgcacgaggccctgcacaaccactacacccagaagagcctgagcctgagcctgggcaag

SEQ ID NO: 30621 - RNA, 1311 nt, synthetic construct
  misc_feature 1..1311: note = derived and/or modified sequence opt4 from Aselizuab_HeavyChain2
  source 1..1311: mol_type = other RNA
gaggtgcagctggtggagagcggcggcggcctggtgcagcccggcggcagcctgagactgagctgcgccgccagcggcttcaccttcagcacctacgccagctgggtgagacaggcccccggcaagggcctggagtgggtggccagcatcagcaccggcggcagcacctactaccccgacagcgtgaagggcagattcaccatcagcagagacaacgccaagaacaccctgtacctgcagaacagcctgagagccgaggacaccgccgtgtactactgcgccagagactacgacggctacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgcacgaggccctgcacaaccactacacccagaagagcctgagcctgagcctgggcaag

SEQ ID NO: 30622 - RNA, 648 nt, synthetic construct
  misc_feature 1..648: note = derived and/or modified sequence opt4 from Aselizuab_LightChain1
  source 1..648: mol_type = other RNA
gacatccagacccagagccccagcagcctgagcgccagcgtgggcgacagagtgaccatcacctgcaaggccagccagagcgtggactacgacggcgacagctacaactggtaccagcagaagcccggcaaggcccccaagctgctgatctacgccgccagcaacctggagagcggcatccccagcagattcagcggcagcggcagcggcaccgacttcaccctgaccatcagcagcctgcagcccgaggacttcgccacctactactgccagcagagcaacgaggacccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30623 - RNA, 1344 nt, synthetic construct
  misc_feature 1..1344: note = derived and/or modified sequence opt4 from Atezolizumab_HeavyChain1
  source 1..1344: mol_type = other RNA
gaggtgcagctggtggagagcggcggcggcctggtgcagcccggcggcagcctgagactgagctgcgccgccagcggcttcaccttcagcgacagctggatccactgggtgagacaggcccccggcaagggcctggagtgggtggcctggatcagcccctacggcggcagcacctactacgccgacagcgtgaagggcagattcaccatcagcgccgacaccagcaagaacaccgcctacctgcagatgaacagcctgagagccgaggacaccgccgtgtactactgcgccagaagacactggcccggcggcttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30624 - RNA, 642 nt, synthetic construct
  misc_feature 1..642: note = derived and/or modified sequence opt4 from Atezolizumab_LightChain1
  source 1..642: mol_type = other RNA
gacatccagatgacccagagccccagcagcctgagcgccagcgtgggcgacagagtgaccatcacctgcagagccagccaggacgtgagcaccgccgtggcctggtaccagcagaagcccggcaaggcccccaagctgctgatctacagcgccagcttcctgtacagcggcgtgcccagcagattcagcggcagcggcagcggcaccgacttcaccctgaccatcagcagcctgcagcccgaggacttcgccacctactactgccagcagtacctgtaccaccccgccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30625 - RNA, 1323 nt, synthetic construct
  misc_feature 1..1323: note = derived and/or modified sequence opt4 from Atinumab_HeavyChain1
  source 1..1323: mol_type = other RNA
gaggtgcagctggtggagagcggcggcggcctggtgcagcccggcggcagcctgagactgagctgcgccgccagcggcttcaccttcagcaactactggatgagctgggtgagacaggcccccggcaagggcctggagtgggtggccaccatcaagcaggacggcagccagaagaactacgtggacagcgtgaagggcagattcaccatcagcagagacaacgccaagaacagcctgtacctgagactgaacagcctgagagccgaggacaccgccgtgtactactgcgccaccgagctgttcgacctgtggggcagaggcagcctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30626 - RNA, 642 nt, synthetic construct
  misc_feature 1..642: note = derived and/or modified sequence opt4 from Atinumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccatcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30627 - RNA, 1329 nt, synthetic construct
  misc_feature 1..1329: note = derived and/or modified sequence opt4 from Atlizuab_HeavyChain1
  source 1..1329: mol_type = other RNA
gtgcagctgcaggagagcggccccggcctggtgagacccagccagaccctgagcctgacctgcaccgtgagcggctacagcatcaccagcgaccacgcctggagctgggtgagacagccccccggcagaggcctggagtggatcggctacatcagctacagcggcatcaccacctacaaccccagcctgaagagcagagtgaccctgagagacaccagcaagaaccagttcagcctgagactgagcagcgtgaccgccgccgacaccgccgtgtactactgcgccagaagcctggccagaaccaccgccgactactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 30628 - RNA, 639 nt, synthetic construct
  misc_feature 1..639: note = derived and/or modified sequence opt4 from Atlizuab_LightChain1
  source 1..639: mol_type = other RNA
gacatccagacccagagccccagcagcctgagcgccagcgtgggcgacagagtgaccatcacctgcagagccagccaggacatcagcagctacctgaactggtaccagcagaagcccggcaaggcccccaagctgctgatctactacaccagcagactgcacagcggcgtgcccagcagattcagcggcagcggcagcggcaccgacttcaccttcaccatcagcagcctgcagcccgaggacatcgccacctactactgccagcagggcaacaccctgccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30629 - RNA, 792 nt, synthetic construct
  misc_feature 1..792: note = derived and/or modified sequence opt4 from Aurograb_SingleChain
  source 1..792: mol_type = other RNA
atggccaaggtgcagctgctgcagagcgccaccgaggtgaagaagcccggcgccagcgtgaaggtgagctgcaaggcctacggctacaccttcaccgactacggcatcacctgggtgagacaggcccccggccagggcctggagtggatgggctggatcagcgcctacaacggctacaccaactacgcccagaagttccaggacagaatcaccatgaccaccgacgccagcaccagcaccgcctacatggagctgagaagcctgagacccgacgacaccgccgtgctgtactgcgccagagacagagaggacgccagcctgctgagagacggccactggggccagggcaccctggtgaccgtgagcagcggcggcggcggcagcggcggcggcggcagcggcggcggcggcagcggcggcggcggcagcgagaccaccctgacccagagccccggcaccctgagcctgagccccggcgagagagccaccctgagctgcagagccagccagatcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcaagctggagcccgaggacttcgccgtgtactactgccagcactacggcagcagcagcccctggaccagcagacccagagaccagagcgacatcaagagagccgccgccctggagcaccaccaccaccaccac

SEQ ID NO: 30630 - RNA, 1350 nt, synthetic construct
  misc_feature 1..1350: note = derived and/or modified sequence opt4 from Avelumab_HeavyChain1
  source 1..1350: mol_type = other RNA
gaggtgcagctgctggagagcggcggcggcctggtgcagcccggcggcagcctgagactgagctgcgccgccagcggcttcaccttcagcagctacatcatgatgtgggtgagacaggcccccggcaagggcctggagtgggtgagcagcatctaccccagcggcggcatcaccttctacgccgacaccgtgaagggcagattcaccatcagcagagacaacagcaagaacaccctgtacctgcagatgaacagcctgagagccgaggacaccgccgtgtactactgcgccagaatcaagctgggcaccgtgaccaccgtggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30631 - RNA, 648 nt, synthetic construct
  misc_feature 1..648: note = derived and/or modified sequence opt4 from Avelumab_LightChain1
  source 1..648: mol_type = other RNA
cagagcgccctgacccagcccgccagcgtgagcggcagccccggccagagcatcaccatcagctgcaccggcaccagcagcgacgtgggcggctacaactacgtgagctggtaccagcagcaccccggcaaggcccccaagctgatgatctacgacgtgagcaacagacccagcggcgtgagcaacagattcagcggcagcaagagcggcaacaccgccagcctgaccatcagcggcctgcaggccgaggacgaggccgactactactgcagcagctacaccagcagcagcaccagagtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30632 - RNA, 1344 nt, synthetic construct
  misc_feature 1..1344: note = derived and/or modified sequence opt4 from Bapineuzumab_HeavyChain1
  source 1..1344: mol_type = other RNA
gaggtgcagctgctggagagcggcggcggcctggtgcagcccggcggcagcctgagactgagctgcgccgccagcggcttcaccttcagcaactacggcatgagctgggtgagacaggcccccggcaagggcctggagtgggtggccagcatcagaagcggcggcggcagaacctactacagcgacaacgtgaagggcagattcaccatcagcagagacaacagcaagaacaccctgtacctgcagatgaacagcctgagagccgaggacaccgccgtgtactactgcgtgagatacgaccactacagcggcagcagcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30633 - RNA, 657 nt, synthetic construct
  misc_feature 1..657: note = derived and/or modified sequence opt4 from Bapineuzumab_LightChain1
  source 1..657: mol_type = other RNA
gacgtggtgatgacccagagccccctgagcctgcccgtgacccccggcgagcccgccagcatcagctgcaagagcagccagagcctgctggacagcgacggcaagacctacctgaactggctgctgcagaagcccggccagagcccccagagactgatctacctggtgagcaagctggacagcggcgtgcccgacagattcagcggcagcggcagcggcaccgacttcaccctgaagatcagcagagtggaggccgaggacgtgggcgtgtactactgctggcagggcacccacttccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30634 - RNA, 1338 nt, synthetic construct
  misc_feature 1..1338: note = derived and/or modified sequence opt4 from Basiliximab_HeavyChain
  source 1..1338: mol_type = other RNA
cagctgcagcagagcggcaccgtgctggccagacccggcgccagcgtgaagatgagctgcaaggccagcggctacagcttcaccagatactggatgcactggatcaagcagagacccggccagggcctggagtggatcggcgccatctaccccggcaacagcgacaccagctacaaccagaagttcgagggcaaggccaagctgaccgccgtgaccagcgccagcaccgcctacatggagctgagcagcctgacccacgaggacagcgccgtgtactactgcagcagagactacggctactacttcgacttctggggccagggcaccaccctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagccccccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30635 - RNA, 630 nt, synthetic construct
  misc_feature 1..630: note = derived and/or modified sequence opt4 from Basiliximab_LightChain
  source 1..630: mol_type = other RNA
cagatcgtgagcacccagagccccgccatcatgagcgccagccccggcgagaaggtgaccatgacctgcagcgccagcagcagcagaagctacatgcagtggtaccagcagaagcccggcaccagccccaagagatggatctacgacaccagcaagctggccagcggcgtgcccgccagattcagcggcagcggcagcggcaccagctacagcctgaccatcagcagcatggaggccgaggacgccgccacctactactgccaccagagaagcagctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgag

SEQ ID NO: 30636 - RNA, 1350 nt, synthetic construct
  misc_feature 1..1350: note = derived and/or modified sequence opt4 from Bavituximab_HeavyChain
  source 1..1350: mol_type = other RNA
gaggtgcagctgcagcagagcggccccgagctggagaagcccggcgccagcgtgaagctgagctgcaaggccagcggctacagcttcaccggctacaacatgaactgggtgaagcagagccacggcaagagcctggagtggatcggccacatcgacccctactacggcgacaccagctacaaccagaagttcagaggcaaggccaccctgaccgtggacaagagcagcagcaccgcctacatgcagctgaagagcctgaccagcgaggacagcgccgtgtactactgcgtgaagggcggctactacggccactggtacttcgacgtgtggggcgccggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30637 - RNA, 642 nt, synthetic construct
  misc_feature 1..642: note = derived and/or modified sequence opt4 from Bavituximab_LightChain
  source 1..642: mol_type = other RNA
gacatccagatgacccagagccccagcagcctgagcgccagcctgggcgagagagtgagcctgacctgcagagccagccaggacatcggcagcagcctgaactggctgcagcagggccccgacggcaccatcaagagactgatctacgccaccagcagcctggacagcggcgtgcccaagagattcagcggcagcagaagcggcagcgactacagcctgaccatcagcagcctggagagcgaggacttcgtggactactactgcctgcagtacgtgagcagcccccccaccttcggcgccggcaccaagctggagctgaagagagccgacgccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30638 - RNA, 624 nt, synthetic construct
  misc_feature 1..624: note = derived and/or modified sequence opt4 from Bavituximab_LightChain_variant_8734_L
  source 1..624: mol_type = other RNA
gacatccagatgacccagagccccagcagcctgagcgccagcctgggcgagagagtgagcctgacctgcagagccagccaggacatcggcagcagcctgaactggctgcagcagggccccgacggcaccatcaagagactgatctacgccaccagcagcctggacagcggcgtgcccaagagattcagcggcagcagaagcggcagcgactacagcctgaccatcagcagcctggagagcgaggacttcgtggactactactgcctgcagtacgtgagcagcccccccaccttcggcgccggcaccaagctggagctgaagagagccgacgccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcaaggccgactacgagaagcacaaggtgtacgcctgcgaggtgacccaccagggcctgagcagccccgtgaccaagagcttcaacagaggcgagtgc

SEQ ID NO: 30639 - RNA, 1368 nt, synthetic construct
  misc_feature 1..1368: note = derived and/or modified sequence opt4 from Begelomab_HeavyChain1
  source 1..1368: mol_type = other RNA
caggtgcagctgcagcagagcggcgccgagctggtgaagcccggcgccagcgtgaagctgagctgcaaggccagcggctacaccttcagaagctacgacatcaactgggtgagacagagacccgagcagggcctggagtggatcggctggatcttccccggcgacggcagcaccaagtacaacgagaagttcaagggcaaggccaccctgaccaccgacaagagcagcagcaccgcctacatgcagctgagcagactgaccagcgaggacagcgccgtgtacttctgcgccagatggaccgtggtgggccccggctacttcgacgtgtggggcgccggcaccaccgtgaccgtgagcagcgccaagaccaccccccccagcgtgtaccccctggcccccggctgcggcgacaccaccggcagcagcgtgaccctgggctgcctggtgaagggctacttccccgagagcgtgaccgtgacctggaacagcggcagcctgagcagcagcgtgcacaccttccccgccctgctgcagagcggcctgtacaccatgagcagcagcgtgaccgtgcccagcagcacctggcccagccagaccgtgacctgcagcgtggcccaccccgccagcagcaccaccgtggacaagaagctggagcccagcggccccatcagcaccatcaacccctgccccccctgcaaggagtgccacaagtgccccgcccccaacctggagggcggccccagcgtgttcatcttcccccccaacatcaaggacgtgctgatgatcagcctgacccccaaggtgacctgcgtggtggtggacgtgagcgaggacgaccccgacgtgcagatcagctggttcgtgaacaacgtggaggtgcacaccgcccagacccagacccacagagaggactacaacagcaccatcagagtggtgagcaccctgcccatccagcaccaggactggatgagcggcaaggagttcaagtgcaaggtgaacaacaaggacctgcccagccccatcgagagaaccatcagcaagatcaagggcctggtgagagccccccaggtgtacatcctgcccccccccgccgagcagctgagcagaaaggacgtgagcctgacctgcctggtggtgggcttcaaccccggcgacatcagcgtggagtggaccagcaacggccacaccgaggagaactacaaggacaccgcccccgtgctggacagcgacggcagctacttcatctacagcaagctgaacatgaagaccagcaagtgggagaagaccgacagcttcagctgcaacgtgagacacgagggcctgaagaactactacctgaagaagaccatcagcagaagccccggcaag

SEQ ID NO: 30640 - RNA, 639 nt, synthetic construct; identical to SEQ ID NO: 30578
  misc_feature 1..639: note = derived and/or modified sequence opt4 from Begelomab_LightChain1
  source 1..639: mol_type = other RNA

SEQ ID NO: 30641 - RNA, 1353 nt, synthetic construct
  misc_feature 1..1353: note = derived and/or modified sequence opt4 from Benralizumab_HeavyChain1
  source 1..1353: mol_type = other RNA
gaggtgcagctggtgcagagcggcgccgaggtgaagaagcccggcgccagcgtgaaggtgagctgcaaggccagcggctacaccttcaccagctacgtgatccactgggtgagacagagacccggccagggcctggcctggatgggctacatcaacccctacaacgacggcaccaagtacaacgagagattcaagggcaaggtgaccatcaccagcgacagaagcaccagcaccgtgtacatggagctgagcagcctgagaagcgaggacaccgccgtgtacctgtgcggcagagagggcatcagatactacggcctgctgggcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30642 - RNA, 642 nt, synthetic construct
  misc_feature 1..642: note = derived and/or modified sequence opt4 from Benralizumab_LightChain1
  source 1..642: mol_type = other RNA
gacatccagatgacccagagccccagcagcctgagcgccagcgtgggcgacagagtgaccatcacctgcggcaccagcgaggacatcatcaactacctgaactggtaccagcagaagcccggcaaggcccccaagctgctgatctaccacaccagcagactgcagagcggcgtgcccagcagattcagcggcagcggcagcggcaccgacttcaccctgaccatcagcagcctgcagcccgaggacttcgccacctactactgccagcagggctacaccctgccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30643 - RNA, 1329 nt, synthetic construct
  misc_feature 1..1329: note = derived and/or modified sequence opt4 from Betalutin_HeavyChain1
  source 1..1329: mol_type = other RNA
gagatccagctgcagcagagcggccccgagctggtgaagcccggcgccagcgtgaaggtgagctgcaaggccagcggctacagcttcaccgactacaacatgtactgggtgaagcagagccacggcaagagcctggagtggatcggctacatcgacccctacaacggcgacaccacctacaaccagaagttcaagggcaaggccaccctgaccgtggacaagagcagcagcaccgccttcatccacctgaacagcctgaccagcgaggacagcgccgtgtactactgcgccagaagcccctacggccactacgccatggactactggggccagggcaccagcgtgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctggttcgtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatggacaccgacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 30644 - RNA, 642 nt, synthetic construct
  misc_feature 1..642: note = derived and/or modified sequence opt4 from Betalutin_LightChain1
  source 1..642: mol_type = other RNA
gacatcgtgatgacccagagccacaagctgctgagcaccagcgtgggcgacagagtgagcatcacctgcaaggccagccaggacgtgagcaccgccgtggactggtaccagcagaagcccggccagagccccaagctgctgatcaactgggccagcaccagacacaccggcgtgcccgacagattcaccggcagcggcagcggcaccgactacaccctgaccatcagcagcatgcaggccgaggacctggccctgtactactgcagacagcactacagcacccccttcaccttcggcagcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 30645 - RNA, 1344 nt, synthetic construct
  misc_feature 1..1344: note = derived and/or modified sequence opt4 from Bevacituzuab_HeavyChain1
  source 1..1344: mol_type = other RNA
gaggtgcagctggtggagagcggcggcggcctggtgcagcccggcggcagcctgagactgagctgcgccgccagcggctacaccttcaccaactacggcaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 30646 - RNA, 639 nt, synthetic construct
  misc_feature 1..639: note = derived and/or modified sequence opt4 from Bevacituzuab_LightChain1
  source 1..639: mol_type = other RNA
gacatccagacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30647 - RNA, 639 nt, synthetic construct
  misc_feature 1..639: note = derived and/or modified sequence opt4 from Bevacizumab_154-aspartic_acid_LightChain
  source 1..639: mol_type = other RNA
gacatccagatgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccgaccagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgag

SEQ ID NO: 30648 - RNA, 639 nt, synthetic construct; identical to SEQ ID NO: 30647
  misc_feature 1..639: note = derived and/or modified sequence opt4 from Bevacizumab_154-substitution_deriv_LightChain
  source 1..639: mol_type = other RNA

SEQ ID NO: 30649 - RNA, 672 nt, synthetic construct
  misc_feature 1..672: note = derived and/or modified sequence opt4 from Bevacizumab_180-serine_HeavyChain
  source 1..672: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgagccagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 30650 - RNA, 672 nt, synthetic construct; identical to SEQ ID NO: 30649
  misc_feature 1..672: note = derived and/or modified sequence opt4 from Bevacizumab_180-substitution_deriv_HeavyCahin
  source 1..672: mol_type = other RNA

SEQ ID NO: 30651 - RNA, 1359 nt, synthetic construct
  misc_feature 1..1359: note = derived and/or modified sequence opt4 from Bevacizumab_beta_HeavyChain1
  source 1..1359: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30652 - RNA, 642 nt, synthetic construct
  misc_feature 1..642: note = derived and/or modified sequence opt4 from Bevacizumab_beta_LightChain1
  source 1..642: mol_type = other RNA
gacatccagatgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30653 - RNA, 687 nt, synthetic construct
  misc_feature 1..687: note = derived and/or modified sequence opt4 from Bevacizumab_FcDomain
  source 1..687: mol_type = other RNA
agctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30654 - RNA, 672 nt, synthetic construct
  misc_feature 1..672: note = derived and/or modified sequence opt4 from Bevacizumab_HeavyChain
  source 1..672: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 30655 - RNA, 1428 nt, synthetic construct
  misc_feature 1..1428: note = derived and/or modified sequence opt4 from Bevacizumab_HeavyChain_variant1
  source 1..1428: mol_type = other RNA
gccagcgccaccatgggctggagctgcatcatcctgttcctggtggccaccgccaccggcgtgcacagcgaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30656 - RNA, 369 nt, synthetic construct
  misc_feature 1..369: note = derived and/or modified sequence opt4 from Bevacizumab_HeavyChain_V-Region
  source 1..369: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagc

SEQ ID NO: 30657 - RNA, 717 nt, synthetic construct
  misc_feature 1..717: note = derived and/or modified sequence opt4 from Bevacizumab_LightChain1
  source 1..717: mol_type = other RNA
gccagcaagctggccaccatgggctggagctgcatcatcctgttcctggtggccaccgccaccggcgtgcacagcgacatccagatgacccagagccccagcagcctgagcgccagcgtgggcgacagagtgaccatcacctgcagagccagccaggacatcagcagctacctgaactggtaccagcagaagcccggcaaggcccccaagctgctgatctactacaccagcagactgcacagcggcgtgcccagcagattcagcggcagcggcagcggcaccgacttcaccttcaccatcagcagcctgcagcccgaggacatcgccacctactactgccagcagggcaacaccctgccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30658 - RNA, 711 nt, synthetic construct
  misc_feature 1..711: note = derived and/or modified sequence opt4 from Bevacizumab_LightChain2
  source 1..711: mol_type = other RNA
gccagcgccaccatgggctggagctgcatcatcctgttcctggtggccaccgccaccggcgtgcacagcgacatccagatgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30659 - RNA, 642 nt, synthetic construct; identical to SEQ ID NO: 30652
  misc_feature 1..642: note = derived and/or modified sequence opt4 from Bevacizumab_LightChain
  source 1..642: mol_type = other RNA

SEQ ID NO: 30660 - RNA, 324 nt, synthetic construct
  misc_feature 1..324: note = derived and/or modified sequence opt4 from Bevacizumab_LightChain_VJ-Region
  source 1..324: mol_type = other RNA
gacatccagatgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagaga

SEQ ID NO: 30661 - RNA, 321 nt, synthetic construct
  misc_feature 1..321: note = derived and/or modified sequence opt4 from Bevacizumab_LightChain_V-Region
  source 1..321: mol_type = other RNA
gacatccagatgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaag

SEQ ID NO: 30662 - RNA, 369 nt, synthetic construct; identical to SEQ ID NO: 30656
  misc_feature 1..369: note = derived and/or modified sequence opt4 from Bevacizumab-rhuMAb-VEGF_HeavyChain_gamma1-Chain_VDJ-Region
  source 1..369: mol_type = other RNA

SEQ ID NO: 30663 - RNA, 321 nt, synthetic construct; identical to SEQ ID NO: 30661
  misc_feature 1..321: note = derived and/or modified sequence opt4 from Bevacizumab-rhuMAb-VEGF_LightChain_VJ-Region
  source 1..321: mol_type = other RNA

SEQ ID NO: 30664 - RNA, 1341 nt, synthetic construct
  misc_feature 1..1341: note = derived and/or modified sequence opt4 from Bevacizumab_gamma1-Chain
  source 1..1341: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagctacgtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcaagaagctgaccgtggacaagagcagatggcagcagggcaacgtgttcagctgcagcgtgatgcacgaggccctgcacaaccactacacccagaagagcctgagcctgagccccggcaag

SEQ ID NO: 30665 - RNA, 1359 nt, synthetic construct
  misc_feature 1..1359: note = derived and/or modified sequence opt4 from Bevacizumab_gamma1-Chain_CH3-Region_mutein
  source 1..1359: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtgcaccctgccccccagcagagacgagctgaccaagaaccaggtgagcctgagctgcgccgtgaagggcttctaccccagcgacatcgccgtggagtgggagagcaacggccagcccgagaacaactacaagaccaccccccccgtgctggacagcgacggcagcttcttcctggtgagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30666 - RNA, 1347 nt, synthetic construct; identical to SEQ ID NO: 30579
  misc_feature 1..1347: note = derived and/or modified sequence opt4 from Bezlotoxumab_HeavyChain1
  source 1..1347: mol_type = other RNA

SEQ ID NO: 30667 - RNA, 645 nt, synthetic construct; identical to SEQ ID NO: 30580
  misc_feature 1..645: note = derived and/or modified sequence opt4 from Bezlotoxumab_LightChain1
  source 1..645: mol_type = other RNA

SEQ ID NO: 30668 - RNA, 1335 nt, synthetic construct
  misc_feature 1..1335: note = derived and/or modified sequence opt4 from Bimagrumab_HeavyChain1
  source 1..1335: mol_type = other RNA
caggtgcagctggtgcagagcggcgccgaggtgaagaagcccggcgccagcgtgaaggtgagctgcaaggccagcggctacaccttcaccagcagctacatcaactgggtgagacaggcccccggccagggcctggagtggatgggcaccatcaaccccgtgagcggcagcaccagctacgcccagaagttccagggcagagtgaccatgaccagagacaccagcatcagcaccgcctacatggagctgagcagactgagaagcgacgacaccgccgtgtactactgcgccagaggcggctggttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30669 - RNA, 1332 nt, synthetic construct
  misc_feature 1..1332: note = derived and/or modified sequence opt4 from Bimagrumab_HeavyChain
  source 1..1332: mol_type = other RNA
caggtgcagctggtgcagagcggcgccgaggtgaagaagcccggcgccagcgtgaaggtgagctgcaaggccagcggctacaccttcaccagcagctacatcaactgggtgagacaggcccccggccagggcctggagtggatgggcaccatcaaccccgtgagcggcagcaccagctacgcccagaagttccagggcagagtgaccatgaccagagacaccagcatcagcaccgcctacatggagctgagcagactgagaagcgacgacaccgccgtgtactactgcgccagaggcggctggttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30670 - RNA, 651 nt, synthetic construct
  misc_feature 1..651: note = derived and/or modified sequence opt4 from Bimagrumab_LightChain1
  source 1..651: mol_type = other RNA
cagagcgccctgacccagcccgccagcgtgagcggcagccccggccagagcatcaccatcagctgcaccggcaccagcagcgacgtgggcagctacaactacgtgaactggtaccagcagcaccccggcaaggcccccaagctgatgatctacggcgtgagcaagagacccagcggcgtgagcaacagattcagcggcagcaagagcggcaacaccgccagcctgaccatcagcggcctgcaggccgaggacgaggccgactactactgcggcaccttcgccggcggcagctactacggcgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30671 - RNA, 1365 nt, synthetic construct
  misc_feature 1..1365: note = derived and/or modified sequence opt4 from Bimekizumab_HeavyChain1
  source 1..1365: mol_type = other RNA
gaggtgcagctggtggagagcggcggcggcctggtgcagcccggcggcagcctgagactgagctgcgccgccagcggcttcaccttcagcgactacaacatggcctgggtgagacaggcccccggcaagggcctggagtgggtggccaccatcacctacgagggcagaaacacctactacagagacagcgtgaagggcagattcaccatcagcagagacaacgccaagaacagcctgtacctgcagatgaacagcctgagagccgaggacaccgccgtgtactactgcgccagccccccccagtactacgagggcagcatctacagactgtggttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30672 - RNA, 642 nt, synthetic construct
  misc_feature 1..642: note = derived and/or modified sequence opt4 from Bimekizumab_LightChain1
  source 1..642: mol_type = other RNA
gccatccagctgacccagagccccagcagcctgagcgccagcgtgggcgacagagtgaccatcacctgcagagccgacgagagcgtgagaaccctgatgcactggtaccagcagaagcccggcaaggcccccaagctgctgatctacctggtgagcaacagcgagatcggcgtgcccgacagattcagcggcagcggcagcggcaccgacttcagactgaccatcagcagcctgcagcccgaggacttcgccacctactactgccagcagacctggagcgacccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30673 - RNA, 1344 nt, synthetic construct
  misc_feature 1..1344: note = derived and/or modified sequence opt4 from Bleselumab_HeavyChain1
  source 1..1344: mol_type = other RNA
cagctgcagctgcaggagagcggccccggcctgctgaagcccagcgagaccctgagcctgacctgcaccgtgagcggcggcagcatcagcagccccggctactacggcggctggatcagacagccccccggcaagggcctggagtggatcggcagcatctacaagagcggcagcacctaccacaaccccagcctgaagagcagagtgaccatcagcgtggacaccagcaagaaccagttcagcctgaagctgagcagcgtgaccgccgccgacaccgccgtgtactactgcaccagacccgtggtgagatacttcggctggttcgacccctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcgagggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30674 - RNA, 639 nt, synthetic construct
  misc_feature 1..639: note = derived and/or modified sequence opt4 from Bleselumab_LightChain1
  source 1..639: mol_type = other RNA
gccatccagctgacccagagccccagcagcctgagcgccagcgtgggcgacagagtgaccatcacctgcagagccagccagggcatcagcagcgccctggcctggtaccagcagaagcccggcaaggcccccaagctgctgatctacgacgccagcaacctggagagcggcgtgcccagcagattcagcggcagcggcagcggcaccgacttcaccctgaccatcagcagcctgcagcccgaggacttcgccacctactactgccagcagttcaacagctaccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30675 - RNA, 1512 nt, synthetic construct
  misc_feature 1..1512: note = derived and/or modified sequence opt4 from Blinatumomab_HeavyChain1
  source 1..1512: mol_type = other RNA
gacatccagctgacccagagccccgccagcctggccgtgagcctgggccagagagccaccatcagctgcaaggccagccagagcgtggactacgacggcgacagctacctgaactggtaccagcagatccccggccagccccccaagctgctgatctacgacgccagcaacctggtgagcggcatcccccccagattcagcggcagcggcagcggcaccgacttcaccctgaacatccaccccgtggagaaggtggacgccgccacctaccactgccagcagagcaccgaggacccctggaccttcggcggcggcaccaagctggagatcaagggcggcggcggcagcggcggcggcggcagcggcggcggcggcagccaggtgcagctgcagcagagcggcgccgagctggtgagacccggcagcagcgtgaagatcagctgcaaggccagcggctacgccttcagcagctactggatgaactgggtgaagcagagacccggccagggcctggagtggatcggccagatctggcccggcgacggcgacaccaactacaacggcaagttcaagggcaaggccaccctgaccgccgacgagagcagcagcaccgcctacatgcagctgagcagcctggccagcgaggacagcgccgtgtacttctgcgccagaagagagaccaccaccgtgggcagatactactacgccatggactactggggccagggcaccaccgtgaccgtgagcagcggcggcggcggcagcgacatcaagctgcagcagagcggcgccgagctggccagacccggcgccagcgtgaagatgagctgcaagaccagcggctacaccttcaccagatacaccatgcactgggtgaagcagagacccggccagggcctggagtggatcggctacatcaaccccagcagaggctacaccaactacaaccagaagttcaaggacaaggccaccctgaccaccgacaagagcagcagcaccgcctacatgcagctgagcagcctgaccagcgaggacagcgccgtgtactactgcgccagatactacgacgaccactactgcctggactactggggccagggcaccaccctgaccgtgagcagcgtggagggcggcagcggcggcagcggcggcagcggcggcagcggcggcgtggacgacatccagctgacccagagccccgccatcatgagcgccagccccggcgagaaggtgaccatgacctgcagagccagcagcagcgtgagctacatgaactggtaccagcagaagagcggcaccagccccaagagatggatctacgacaccagcaaggtggccagcggcgtgccctacagattcagcggcagcggcagcggcaccagctacagcctgaccatcagcagcatggaggccgaggacgccgccacctactactgccagcagtggagcagcaaccccctgaccttcggcgccggcaccaagctggagctgaagcaccaccaccaccaccac

SEQ ID NO: 30676 - RNA, 1512 nt, synthetic construct; identical to SEQ ID NO: 30675
  misc_feature 1..1512: note = derived and/or modified sequence opt4 from Blinatumomab_SingleChain
  source 1..1512: mol_type = other RNA

SEQ ID NO: 30677 - RNA, 1512 nt, synthetic construct; identical to SEQ ID NO: 30675
  misc_feature 1..1512: note = derived and/or modified sequence opt4 from Blinatumumab_SingleChain_variable_fragment_fusion_protein_( bite)
  source 1..1512: mol_type = other RNA

SEQ ID NO: 30678 - RNA, 1344 nt, synthetic construct
  misc_feature 1..1344: note = derived and/or modified sequence opt4 from Blontuvetmab_HeavyChain
  source 1..1344: mol_type = other RNA
caggtgcagctgcagcagagcagagccgagctggtgagacccggcgccagcgtgaccctgagctgcaagcccagcggctacaccttcaccgactacgaggtgcactgggtgaagcagacccccgtgcacggcctggagtggatcggcgccatcgaccccgagaccggcggcaccgccgacaaccagaagttcaagggcaaggccatcctgaccgccgacaagagcagcagcaccgcctacatggagctgagaagcctgaccagcgaggacagcgccgtgtactactgcaccaacttcgtggacgtgtggggcaccggcaccaccgtgaccgtgagcagcgccagcaccaccgcccccagcgtgttccccctggcccccagctgcggcagccagagcggcagcaccgtggccctggcctgcctggtgagcggctacttccccgagcccgtgaccgtgagctggaacagcggcagcctgaccagcggcgtgcacaccttccccagcgtgctgcagagcagcggcctgtacagcctgagcagcatggtgaccgtgcccagcagcagatggcccagcgagaccttcacctgcaacgtggcccaccccgccagcaagaccaaggtggacaagcccgtgcccaagagagagaacggcagagtgcccagaccccccgactgccccaagtgccccgcccccgagatgctgggcggccccagcgtgttcatcttcccccccaagcccaaggacaccctgctgatcgccagaacccccgaggtgacctgcgtggtggtggacctggaccccgaggaccccgaggtgcagatcagctggttcgtggacggcaagcagatgcagaccgccaagacccagcccagagaggagcagttcaacggcacctacagagtggtgagcgtgctgcccatcggccaccaggactggctgaagggcaagcagttcacctgcaaggtgaacaacaaggccctgcccagccccatcgagagaaccatcagcaaggccagaggccaggcccaccagcccagcgtgtacgtgctgccccccagcagagaggagctgagcaagaacaccgtgagcctgacctgcctgatcaaggacttcttcccccccgacatcgacgtggagtggcagagcaacggccagcaggagcccgagagcaagtacagaaccacccccccccagctggacgaggacggcagctacttcctgtacagcaagctgagcgtggacaagagcagatggcagagaggcgacaccttcatctgcgccgtgatgcacgaggccctgcacaaccactacacccagaagagcctgagccacagccccggcaag

SEQ ID NO: 30679 - RNA, 657 nt, synthetic construct
  misc_feature 1..657: note = derived and/or modified sequence opt4 from Blontuvetmab_LightChain
  source 1..657: mol_type = other RNA
gacgtggtgatgagccagagccccagcagcctggccgtgagcgtgggcgagaaggtgaccatgagctgcaagagcagccagagcctgctgtacagcggcaaccagaagaactacctggcctggtaccagcagaagcccggccagagccccagactgctgatctactgggccagcaccagagagagcggcgtgcccgacagattcaccggcagcggcagcggcaccgacttcaccctgaccatcagcagcgtgaaggccgaggacctggccgtgttctactgccagcagtactacaactaccccctgaccttcggcggcggcacccacctgaccgtgctgggccagcccaaggccagccccagcgtgaccctgttcccccccagcagcgaggagctgggcgccaacaaggccaccctggtgtgcctgatcagcgacttctaccccagcggcgtgaccgtggcctggaaggccgacggcagccccatcacccagggcgtggagaccaccaagcccagcaagcagagcaacaacaagtacgccgccagcagctacctgagcctgacccccgacaagtggaagagccacagcagcttcagctgcctggtgacccacgagggcagcaccgtggagaagaaggtggcccccgccgagtgcagc

SEQ ID NO: 30680 - RNA, 1332 nt, synthetic construct
  misc_feature 1..1332: note = derived and/or modified sequence opt4 from Blosozumab_HeavyChain1
  source 1..1332: mol_type = other RNA
caggtgcagctggtgcagagcggcgccgaggtgaagaagcccggcgccagcgtgaaggtgagctgcaaggtgagcggcttccccatcaaggacaccttccagcactgggtgagacaggcccccggcaagggcctggagtggatgggctggagcgaccccgagatcggcgacaccgagtacgccagcaagttccagggcagagtgaccatgaccgaggacaccagcaccgacaccgcctacatggagctgagcagcctgagaagcgaggacaccgccgtgtactactgcgccaccggcgacaccacctacaagttcgacttctggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 30681 - RNA, 642 nt, synthetic construct
  misc_feature 1..642: note = derived and/or modified sequence opt4 from Blosozumab_LightChain1
  source 1..642: mol_type = other RNA
gacatccagatgacccagagccccagcagcctgagcgccagcgtgggcgacagagtgaccatcacctgcaaggccagccaggacgtgcacaccgccgtggcctggtaccagcagaagcccggcaaggcccccaagctgctgatctactgggccagcaccagatggaccggcgtgcccagcagattcagcggcagcggcagcggcaccgacttcaccctgaccatcagcagcctgcagcccgaggacttcgccacctactactgccagcagtacagcgactacccctggaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30682 - RNA, 1332 nt, synthetic construct
  misc_feature 1..1332: note = derived and/or modified sequence opt4 from Bococizumab_HeavyChain1
  source 1..1332: mol_type = other RNA
caggtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatgggcgagatcagccccttcggcggcagaaccaactacaacgagaagttcaagagcagagtgaccatgaccagagacaccagcaccagcaccgtgtacatggagctgagcagcctgagaagcgaggacaccgccgtgtactactgcgccagagagagacccctgtacgccagcgacctgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30683 - RNA, 642 nt, synthetic construct
  misc_feature 1..642: note = derived and/or modified sequence opt4 from Bococizumab_LightChain1
  source 1..642: mol_type = other RNA
gacatccagatgacccagagccccagcagcctgagcgccagcgtgggcgacagagtgaccatcacctgcagagccagccagggcatcagcagcgccctggcctggtaccagcagaagcccggcaaggcccccaagctgctgatctacagcgccagctacagatacaccggcgtgcccagcagattcagcggcagcggcagcggcaccgacttcaccttcaccatcagcagcctgcagcccgaggacatcgccacctactactgccagcagagatacagcctgtggagaaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30684 - RNA, 1338 nt, synthetic construct
  misc_feature 1..1338: note = derived and/or modified sequence opt4 from Brentuximab_vedotin_HeavyChain1
  source 1..1338: mol_type = other RNA
cagatccagctgcagcagagcggccccgaggtggtgaagcccggcgccagcgtgaagatcagctgcaaggccagcggctacaccttcaccgactactacatcacctgggtgaagcagaagcccggccagggcctggagtggatcggctggatctaccccggcagcggcaacaccaagtacaacgagaagttcaagggcaaggccaccctgaccgtggacaccagcagcagcaccgccttcatgcagctgagcagcctgaccagcgaggacaccgccgtgtacttctgcgccaactacggcaactactggttcgcctactggggccagggcacccaggtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30685 - RNA, 654 nt, synthetic construct
  misc_feature 1..654: note = derived and/or modified sequence opt4 from Brentuximab_vedotin_LightChain1
  source 1..654: mol_type = other RNA
gacatcgtgctgacccagagccccgccagcctggccgtgagcctgggccagagagccaccatcagctgcaaggccagccagagcgtggacttcgacggcgacagctacatgaactggtaccagcagaagcccggccagccccccaaggtgctgatctacgccgccagcaacctggagagcggcatccccgccagattcagcggcagcggcagcggcaccgacttcaccctgaacatccaccccgtggaggaggaggacgccgccacctactactgccagcagagcaacgaggacccctggaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30686 - RNA, 1335 nt, synthetic construct
  misc_feature 1..1335: note = derived and/or modified sequence opt4 from Briakinumab_HeavyChain1
  source 1..1335: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccttcatcagatacgacggcagcaacaagtactacgccgacagcgtgaagggcagattcaccatcagcagagacaacagcaagaacaccctgtacctgcagatgaacagcctgagagccgaggacaccgccgtgtactactgcaagacccacggcagccacgacaactggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30687 - RNA, 651 nt, synthetic construct
  misc_feature 1..651: note = derived and/or modified sequence opt4 from Briakinumab_LightChain1
  source 1..651: mol_type = other RNA
cagagcgtgctgacccagccccccagcgtgagcggcgcccccggccagagagtgaccatcagctgcagcggcagcagaagcaacatcggcagcaacaccgtgaagtggtaccagcagctgcccggcaccgcccccaagctgctgatctactacaacgaccagagacccagcggcgtgcccgacagattcagcggcagcaagagcggcaccagcgccagcctggccatcaccggcctgcaggccgaggacgaggccgactactactgccagagctacgacagatacacccaccccgccctgctgttcggcaccggcaccaaggtgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30688 - RNA, 1326 nt, synthetic construct
  misc_feature 1..1326: note = derived and/or modified sequence opt4 from Brodalumab_HeavyChain1
  source 1..1326: mol_type = other RNA
caggtgcagctggtgcagagcggcgccgaggtgaagaagcccggcgccagcgtgaaggtgagctgcaaggccagcggctacaccttcaccagatacggcatcagctgggtgagacaggcccccggccagggcctggagtggatgggctggatcagcacctacagcggcaacaccaactacgcccagaagctgcagggcagagtgaccatgaccaccgacaccagcaccagcaccgcctacatggagctgagaagcctgagaagcgacgacaccgccgtgtactactgcgccagaagacagctgtacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30689 - RNA, 642 nt, synthetic construct
  misc_feature 1..642: note = derived and/or modified sequence opt4 from Brodalumab_LightChain1
  source 1..642: mol_type = other RNA
gagatcgtgatgacccagagccccgccaccctgagcgtgagccccggcgagagagccaccctgagctgcagagccagccagagcgtgagcagcaacctggcctggttccagcagaagcccggccaggcccccagacccctgatctacgacgccagcaccagagccaccggcgtgcccgccagattcagcggcagcggcagcggcaccgacttcaccctgaccatcagcagcctgcagagcgaggacttcgccgtgtactactgccagcagtacgacaactggcccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30690 - RNA, 756 nt, synthetic construct
  misc_feature 1..756: note = derived and/or modified sequence opt4 from Brolucizumab_HeavyChain1
  source 1..756: mol_type = other RNA
atggagatcgtgatgacccagagccccagcaccctgagcgccagcgtgggcgacagagtgatcatcacctgccaggccagcgagatcatccacagctggctggcctggtaccagcagaagcccggcaaggcccccaagctgctgatctacctggccagcaccctggccagcggcgtgcccagcagattcagcggcagcggcagcggcgccgagttcaccctgaccatcagcagcctgcagcccgacgacttcgccacctactactgccagaacgtgtacctggccagcaccaacggcgccaacttcggccagggcaccaagctgaccgtgctgggcggcggcggcggcagcggcggcggcggcagcggcggcggcggcagcggcggcggcggcagcgaggtgcagctggtggagagcggcggcggcctggtgcagcccggcggcagcctgagactgagctgcaccgccagcggcttcagcctgaccgactactactacatgacctgggtgagacaggcccccggcaagggcctggagtgggtgggcttcatcgaccccgacgacgacccctactacgccacctgggccaagggcagattcaccatcagcagagacaacagcaagaacaccctgtacctgcagatgaacagcctgagagccgaggacaccgccgtgtactactgcgccggcggcgaccacaacagcggctggggcctggacatctggggccagggcaccctggtgaccgtgagcagc

SEQ ID NO: 30691 - RNA, 756 nt, synthetic construct; identical to SEQ ID NO: 30690
  misc_feature 1..756: note = derived and/or modified sequence opt4 from Brolucizumab_scFv_fragment
  source 1..756: mol_type = other RNA

SEQ ID NO: 30692 - RNA, 1341 nt, synthetic construct
  misc_feature 1..1341: note = derived and/or modified sequence opt4 from Brontictuzumab_HeavyChain1
  source 1..1341: mol_type = other RNA
caggtgcagctggtgcagagcggcgccgaggtgaagaagcccggcgccagcgtgaagatcagctgcaaggtgagcggctacaccctgagaggctactggatcgagtgggtgagacaggcccccggcaagggcctggagtggatcggccagatcctgcccggcaccggcagaaccaactacaacgagaagttcaagggcagagtgaccatgaccgccgacaccagcaccgacaccgcctacatggagctgagcagcctgagaagcgaggacaccgccgtgtactactgcgccagattcgacggcaactacggctactacgccatggactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30693 - RNA, 645 nt, synthetic construct
  misc_feature 1..645: note = derived and/or modified sequence opt4 from Brontictuzumab_LightChain1
  source 1..645: mol_type = other RNA
caggccgtggtgacccaggagcccagcctgaccgtgagccccggcggcaccgtgaccctgacctgcagaagcagcaccggcgccgtgaccaccagcaactacgccaactggttccagcagaagcccggccaggcccccagaaccctgatcggcggcaccaacaacagagcccccggcgtgcccgccagattcagcggcagcctgctgggcggcaaggccgccctgaccctgagcggcgcccagcccgaggacgaggccgagtactactgcgccctgtggtacagcaaccactgggtgttcggcggcggcaccaagctgaccgtgctgggccagcccaaggccgcccccagcgtgaccctgttcccccccagcagcgaggagctgcaggccaacaaggccaccctggtgtgcctggtgagcgacttctaccccggcgccgtgaccgtggcctggaaggccgacggcagccccgtgaaggtgggcgtggagaccaccaagcccagcaagcagagcaacaacaagtacgccgccagcagctacctgagcctgacccccgagcagtggaagagccacagaagctacagctgcagagtgacccacgagggcagcaccgtggagaagaccgtggcccccgccgagtgcagc

SEQ ID NO: 30694 - RNA, 1332 nt, synthetic construct
  misc_feature 1..1332: note = derived and/or modified sequence opt4 from BTT-1023_HeavyChain1
  source 1..1332: mol_type = other RNA
caggtgcagctggtggagagcggcggcggcgtggtgcagcccggcagaagcctgagactgagctgcgccgccagcggcttcaccttcttcagctacgccatgcactgggtgagacagacccccggcaagggcctggagtgggtggccgtgatctggttcgacggcagcaacgagaactacgtggacagcgtgaagggcagattcaccatcagcagagacaacagcaagaacaccctgtacctgcagatgaacaccctgagagccgaggacaccgccgtgtactactgcgccagagacgcctggagctacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcgccggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30695 - RNA, 642 nt, synthetic construct
  misc_feature 1..642: note = derived and/or modified sequence opt4 from BTT-1023_LightChain1
  source 1..642: mol_type = other RNA
gtgatccagctgacccagagccccagcagcctgagcgccagcgtgggcgacagagtgaccatcacctgcagagccagccagggcatcagcagagccctggcctggtaccagcagaagcccggcaagggccccaagctgctgatctacgacgccagcagcctggagagcggcgtgcccagcagattcagcggcagcggcagcggcaccgacttcaccctgaccatcagcagcctgcagcccgaggacttcgccacctactactgccagcagttcaacagctaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30696 - RNA, 1341 nt, synthetic construct
  misc_feature 1..1341: note = derived and/or modified sequence opt4 from Burosumab_HeavyChain1
  source 1..1341: mol_type = other RNA
caggtgcagctggtgcagagcggcgccgaggtgaagaagcccggcgccagcgtgaaggtgagctgcaaggccagcggctacaccttcaccaaccactacatgcactgggtgagacaggcccccggccagggcctggagtggatgggcatcatcaaccccatcagcggcagcaccagcaacgcccagaagttccagggcagagtgaccatgaccagagacaccagcaccagcaccgtgtacatggagctgagcagcctgagaagcgaggacaccgccgtgtactactgcgccagagacatcgtggacgccttcgacttctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30697 - RNA, 639 nt, synthetic construct
  misc_feature 1..639: note = derived and/or modified sequence opt4 from Burosumab_LightChain1
  source 1..639: mol_type = other RNA
gccatccagctgacccagagccccagcagcctgagcgccagcgtgggcgacagagtgaccatcacctgcagagccagccagggcatcagcagcgccctggtgtggtaccagcagaagcccggcaaggcccccaagctgctgatctacgacgccagcagcctggagagcggcgtgcccagcagattcagcggcagcggcagcggcaccgacttcaccctgaccatcagcagcctgcagcccgaggacttcgccacctactactgccagcagttcaacgactacttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30698 - RNA, 1344 nt, synthetic construct
  misc_feature 1..1344: note = derived and/or modified sequence opt4 from Canakinumab_HeavyChain1
  source 1..1344: mol_type = other RNA
caggtgcagctggtggagagcggcggcggcgtggtgcagcccggcagaagcctgagactgagctgcgccgccagcggcttcaccttcagcgtgtacggcatgaactgggtgagacaggcccccggcaagggcctggagtgggtggccatcatctggtacgacggcgacaaccagtactacgccgacagcgtgaagggcagattcaccatcagcagagacaacagcaagaacaccctgtacctgcagatgaacggcctgagagccgaggacaccgccgtgtactactgcgccagagacctgagaaccggccccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30699 - RNA, 1344 nt, synthetic construct; identical to SEQ ID NO: 30698
  misc_feature 1..1344: note = derived and/or modified sequence opt4 from Canakinumab_HeavyChain
  source 1..1344: mol_type = other RNA

SEQ ID NO: 30700 - RNA, 642 nt, synthetic construct
  misc_feature 1..642: note = derived and/or modified sequence opt4 from Canakinumab_LightChain1
  source 1..642: mol_type = other RNA
gagatcgtgctgacccagagccccgacttccagagcgtgacccccaaggagaaggtgaccatcacctgcagagccagccagagcatcggcagcagcctgcactggtaccagcagaagcccgaccagagccccaagctgctgatcaagtacgccagccagagcttcagcggcgtgcccagcagattcagcggcagcggcagcggcaccgacttcaccctgaccatcaacagcctggaggccgaggacgccgccgcctactactgccaccagagcagcagcctgcccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30701 - RNA, 642 nt, synthetic construct; identical to SEQ ID NO: 30700
  misc_feature 1..642: note = derived and/or modified sequence opt4 from Canakinumab_LightChain
  source 1..642: mol_type = other RNA

SEQ ID NO: 30702 - RNA, 1182 nt, synthetic construct
  misc_feature 1..1182: note = derived and/or modified sequence opt4 from Canakinumab_LightChain_variant_8836_L
  source 1..1182: mol_type = other RNA
caggtgcagctggtggagagcggcggcggcgtggtgcagcccggcagaagcctgagactgagctgcgccgccagcggcttcaccttcagcgtgtacggcatgaactgggtgagacaggcccccggcaagggcctggagtgggtggccatcatctggtacgacggcgacaaccagtactacgccgacagcgtgaagggcagattcaccatcagcagagacaacagcaagaacaccctgtacctgcagatgaacggcctgagagccgaggacaccgccgtgtactactgcgccagagacctgagaaccggccccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctggagatcgtgctgacccagagccccgacttccagagcgtgacccccaaggagaaggtgaccatcacctgcagagccagccagagcatcggcagcagcctgcactggtaccagcagaagcccgaccagagccccaagctgctgatcaagtacgccagccagagcttcagcggcgtgcccagcagattcagcggcagcggcagcggcaccgacttcaccctgaccatcaacagcctggaggccgaggacgccgccgcctactactgccaccagagcagcagcctgcccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30703 - RNA, 1197 nt, synthetic construct
  misc_feature 1..1197: note = derived and/or modified sequence opt4 from Cantuzumab_HeavyChain1
  source 1..1197: mol_type = other RNA
atcgacaccaccaccggcgagcccacctacgcccagaagttccagggcagaatcgccttcagcctggagaccagcgccagcaccgcctacctgcagatcaagagcctgaagagcgaggacaccgccacctacttctgcgccagaagaggcccctacaactggtacttcgacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30704 - RNA, 1347 nt, synthetic construct
  misc_feature 1..1347: note = derived and/or modified sequence opt4 from Cantuzumab_HeavyChain
  source 1..1347: mol_type = other RNA
caggtgcagctggtgcagagcggcgccgaggtgaagaagcccggcgagaccgtgaagatcagctgcaaggccagcgactacaccttcacctactacggcatgaactgggtgaagcaggcccccggccagggcctgaagtggatgggctggatcgacaccaccaccggcgagcccacctacgcccagaagttccagggcagaatcgccttcagcctggagaccagcgccagcaccgcctacctgcagatcaagagcctgaagagcgaggacaccgccacctacttctgcgccagaagaggcccctacaactggtacttcgacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30705 - RNA, 657 nt, synthetic construct
  misc_feature 1..657: note = derived and/or modified sequence opt4 from Cantuzumab_LightChain1
  source 1..657: mol_type = other RNA
gacatcgtgatgacccagagccccctgagcgtgcccgtgacccccggcgagcccgtgagcatcagctgcagaagcagcaagagcctgctgcacagcaacggcaacacctacctgtactggttcctgcagagacccggccagagcccccagctgctgatctacagaatgagcaacctggtgagcggcgtgcccgacagattcagcggcagcggcagcggcaccgccttcaccctgagaatcagcagagtggaggccgaggacgtgggcgtgtactactgcctgcagcacctggagtaccccttcaccttcggccccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30706 - RNA, 1344 nt, synthetic construct
  misc_feature 1..1344: note = derived and/or modified sequence opt4 from Cantuzumab_mertansine_HeavyChain1
  source 1..1344: mol_type = other RNA
gtgcagctggtgcagagcggcgccgaggtgaagaagcccggcgagaccgtgaagatcagctgcaaggccagcgactacaccttcacctactacggcatgaactgggtgaagcaggcccccggccagggcctgaagtggatgggctggatcgacaccaccaccggcgagcccacctacgcccagaagttccagggcagaatcgccttcagcctggagaccagcgccagcaccgcctacctgcagatcaagagcctgaagagcgaggacaccgccacctacttctgcgccagaagaggcccctacaactggtacttcgacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30707 - RNA, 657 nt, synthetic construct; identical to SEQ ID NO: 30705
  misc_feature 1..657: note = derived and/or modified sequence opt4 from Cantuzumab_mertansine_LightChain1
  source 1..657: mol_type = other RNA

SEQ ID NO: 30708 - RNA, 1347 nt, synthetic construct; identical to SEQ ID NO: 30704
  misc_feature 1..1347: note = derived and/or modified sequence opt4 from Cantuzumab_ravtansine_HeavyChain1
  source 1..1347: mol_type = other RNA

SEQ ID NO: 30709 - RNA, 657 nt, synthetic construct; identical to SEQ ID NO: 30705
  misc_feature 1..657: note = derived and/or modified sequence opt4 from Cantuzumab_ravtansine_LightChain1
  source 1..657: mol_type = other RNA

SEQ ID NO: 30710 - RNA, 777 nt, synthetic construct
  misc_feature 1..777: note = derived and/or modified sequence opt4 from Caplacizumab
  source 1..777: mol_type = other RNA
gaggtgcagctggtggagagcggcggcggcctggtgcagcccggcggcagcctgagactgagctgcgccgccagcggcagaaccttcagctacaaccccatgggctggttcagacaggcccccggcaagggcagagagctggtggccgccatcagcagaaccggcggcagcacctactaccccgacagcgtggagggcagattcaccatcagcagagacaacgccaagagaatggtgtacctgcagatgaacagcctgagagccgaggacaccgccgtgtactactgcgccgccgccggcgtgagagccgaggacggcagagtgagaaccctgcccagcgagtacaccttctggggccagggcacccaggtgaccgtgagcagcgccgccgccgaggtgcagctggtggagagcggcggcggcctggtgcagcccggcggcagcctgagactgagctgcgccgccagcggcagaaccttcagctacaaccccatgggctggttcagacaggcccccggcaagggcagagagctggtggccgccatcagcagaaccggcggcagcacctactaccccgacagcgtggagggcagattcaccatcagcagagacaacgccaagagaatggtgtacctgcagatgaacagcctgagagccgaggacaccgccgtgtactactgcgccgccgccggcgtgagagccgaggacggcagagtgagaaccctgcccagcgagtacaccttctggggccagggcacccaggtgaccgtgagcagc

SEQ ID NO: 30711 - RNA, 777 nt, synthetic construct; identical to SEQ ID NO: 30710
  misc_feature 1..777: note = derived and/or modified sequence opt4 from Caplacizumab_HeavyChain1
  source 1..777: mol_type = other RNA

SEQ ID NO: 30712 - RNA, 777 nt, synthetic construct; identical to SEQ ID NO: 30710
  misc_feature 1..777: note = derived and/or modified sequence opt4 from Caplacizumab_HeavyChain1
  source 1..777: mol_type = other RNA

SEQ ID NO: 30713 - RNA, 1347 nt, synthetic construct
  misc_feature 1..1347: note = derived and/or modified sequence opt4 from Carlumab_HeavyChain1
  source 1..1347: mol_type = other RNA
caggtgcagctggtgcagagcggcgccgaggtgaagaagcccggcagcagcgtgaaggtgagctgcaaggccagcggcggcaccttcagcagctacggcatcagctgggtgagacaggcccccggccagggcctggagtggatgggcggcatcatccccatcttcggcaccgccaactacgcccagaagttccagggcagagtgaccatcaccgccgacgagagcaccagcaccgcctacatggagctgagcagcctgagaagcgaggacaccgccgtgtactactgcgccagatacgacggcatctacggcgagctggacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30714 - RNA, 648 nt, synthetic construct
  misc_feature 1..648: note = derived and/or modified sequence opt4 from Carlumab_LightChain1
  source 1..648: mol_type = other RNA
gagatcgtgctgacccagagccccgccaccctgagcctgagccccggcgagagagccaccctgagctgcagagccagccagagcgtgagcgacgcctacctggcctggtaccagcagaagcccggccaggcccccagactgctgatctacgacgccagcagcagagccaccggcgtgcccgccagattcagcggcagcggcagcggcaccgacttcaccctgaccatcagcagcctggagcccgaggacttcgccgtgtactactgccaccagtacatccagctgcacagcttcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30715 - RNA, 1353 nt, synthetic construct
  misc_feature 1..1353: note = derived and/or modified sequence opt4 from Cergutuzumab_amunaleukin_HeavyChain1
  source 1..1353: mol_type = other RNA
caggtgcagctggtgcagagcggcgccgaggtgaagaagcccggcgccagcgtgaaggtgagctgcaaggccagcggctacaccttcaccgagttcggcatgaactgggtgagacaggcccccggccagggcctggagtggatgggctggatcaacaccaagaccggcgaggccacctacgtggaggagttcaagggcagagtgaccttcaccaccgacaccagcaccagcaccgcctacatggagctgagaagcctgagaagcgacgacaccgccgtgtactactgcgccagatgggacttcgcctactacgtggaggccatggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgggcgcccccatcgagaagaccatcagcaaggccaagggccagcccagagagccccaggtgtgcaccctgccccccagcagagacgagctgaccaagaaccaggtgagcctgagctgcgccgtgaagggcttctaccccagcgacatcgccgtggagtgggagagcaacggccagcccgagaacaactacaagaccaccccccccgtgctggacagcgacggcagcttcttcctggtgagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30716 - RNA, 1794 nt, synthetic construct
  misc_feature 1..1794: note = derived and/or modified sequence opt4 from Cergutuzumab_amunaleukin_HeavyChain2
  source 1..1794: mol_type = other RNA
caggtgcagctggtgcagagcggcgccgaggtgaagaagcccggcgccagcgtgaaggtgagctgcaaggccagcggctacaccttcaccgagttcggcatgaactgggtgagacaggcccccggccagggcctggagtggatgggctggatcaacaccaagaccggcgaggccacctacgtggaggagttcaagggcagagtgaccttcaccaccgacaccagcaccagcaccgcctacatggagctgagaagcctgagaagcgacgacaccgccgtgtactactgcgccagatgggacttcgcctactacgtggaggccatggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgggcgcccccatcgagaagaccatcagcaaggccaagggccagcccagagagccccaggtgtacaccctgcccccctgcagagacgagctgaccaagaaccaggtgagcctgtggtgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcggcggcggcggcagcggcggcggcggcagcggcggcggcggcagcgcccccgccagcagcagcaccaagaagacccagctgcagctggagcacctgctgctggacctgcagatgatcctgaacggcatcaacaactacaagaaccccaagctgaccagaatgctgaccgccaagttcgccatgcccaagaaggccaccgagctgaagcacctgcagtgcctggaggaggagctgaagcccctggaggaggtgctgaacggcgcccagagcaagaacttccacctgagacccagagacctgatcagcaacatcaacgtgatcgtgctggagctgaagggcagcgagaccaccttcatgtgcgagtacgccgacgagaccgccaccatcgtggagttcctgaacagatggatcaccttcgcccagagcatcatcagcaccctgacc

SEQ ID NO: 30717 - RNA, 645 nt, synthetic construct
  misc_feature 1..645: note = derived and/or modified sequence opt4 from Cergutuzumab_amunaleukin_LightChain1
  source 1..645: mol_type = other RNA
gacatccagatgacccagagccccagcagcctgagcgccagcgtgggcgacagagtgaccatcacctgcaaggccagcgccgccgtgggcacctacgtggcctggtaccagcagaagcccggcaaggcccccaagctgctgatctacagcgccagctacagaaagagaggcgtgcccagcagattcagcggcagcggcagcggcaccgacttcaccctgaccatcagcagcctgcagcccgaggacttcgccacctactactgccaccagtactacacctaccccctgttcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30718 - RNA, 687 nt, synthetic construct
  misc_feature 1..687: note = derived and/or modified sequence opt4 from Certolizumab_pegol_HeavyChain1
  source 1..687: mol_type = other RNA
gaggtgcagctggtggagagcggcggcggcctggtgcagcccggcggcagcctgagactgagctgcgccgccagcggctacgtgttcaccgactacggcatgaactgggtgagacaggcccccggcaagggcctggagtggatgggctggatcaacacctacatcggcgagcccatctacgccgacagcgtgaagggcagattcaccttcagcctggacaccagcaagagcaccgcctacctgcagatgaacagcctgagagccgaggacaccgccgtgtactactgcgccagaggctacagaagctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgcgccgcc

SEQ ID NO: 30719 - RNA, 687 nt, synthetic construct; identical to SEQ ID NO: 30718
  misc_feature 1..687: note = derived and/or modified sequence opt4 from Certolizumab_pegol_HeavyChain
  source 1..687: mol_type = other RNA

SEQ ID NO: 30720 - RNA, 642 nt, synthetic construct
  misc_feature 1..642: note = derived and/or modified sequence opt4 from Certolizumab_pegol_LightChain1
  source 1..642: mol_type = other RNA
gacatccagatgacccagagccccagcagcctgagcgccagcgtgggcgacagagtgaccatcacctgcaaggccagccagaacgtgggcaccaacgtggcctggtaccagcagaagcccggcaaggcccccaaggccctgatctacagcgccagcttcctgtacagcggcgtgccctacagattcagcggcagcggcagcggcaccgacttcaccctgaccatcagcagcctgcagcccgaggacttcgccacctactactgccagcagtacaacatctaccccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30721 - RNA, 642 nt, synthetic construct; identical to SEQ ID NO: 30720
  misc_feature 1..642: note = derived and/or modified sequence opt4 from Certolizumab_pegol_LightChain
  source 1..642: mol_type = other RNA

SEQ ID NO: 30722 - RNA, 1356 nt, synthetic construct
  misc_feature 1..1356: note = derived and/or modified sequence opt4 from Cetuximab_HeavyChain
  source 1..1356: mol_type = other RNA
caggtgcagctgaagcagagcggccccggcctggtgcagcccagccagagcctgagcatcacctgcaccgtgagcggcttcagcctgaccaactacggcgtgcactgggtgagacagagccccggcaagggcctggagtggctgggcgtgatctggagcggcggcaacaccgactacaacacccccttcaccagcagactgagcatcaacaaggacaacagcaagagccaggtgttcttcaagatgaacagcctgcagagcaacgacaccgccatctactactgcgccagagccctgacctactacgactacgagttcgcctactggggccagggcaccctggtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagccccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30723 - RNA, 1347 nt, synthetic construct
  misc_feature 1..1347: note = derived and/or modified sequence opt4 from Cetuximab_HeavyChain_variant
  source 1..1347: mol_type = other RNA
caggtgcagctgaagcagagcggccccggcctggtgcagcccagccagagcctgagcatcacctgcaccgtgagcggcttcagcctgaccaactacggcgtgcactgggtgagacagagccccggcaagggcctggagtggctgggcgtgatctggagcggcggcaacaccgactacaacacccccttcaccagcagactgagcatcaacaaggacaacagcaagagccaggtgttcttcaagatgaacagcctgcagagcaacgacaccgccatctactactgcgccagagccctgacctactacgactacgagttcgcctactggggccagggcaccctggtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30724 - RNA, 639 nt, synthetic construct
  misc_feature 1..639: note = derived and/or modified sequence opt4 from Cetuximab_LightChain
  source 1..639: mol_type = other RNA
gacatcctgctgacccagagccccgtgatcctgagcgtgagccccggcgagagagtgagcttcagctgcagagccagccagagcatcggcaccaacatccactggtaccagcagagaaccaacggcagccccagactgctgatcaagtacgccagcgagagcatcagcggcatccccagcagattcagcggcagcggcagcggcaccgacttcaccctgagcatcaacagcgtggagagcgaggacatcgccgactactactgccagcagaacaacaactggcccaccaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgcc

SEQ ID NO: 30725 - RNA, 642 nt, synthetic construct
  misc_feature 1..642: note = derived and/or modified sequence opt4 from Cetuximab_LightChain_variant
  source 1..642: mol_type = other RNA
gacatcctgctgacccagagccccgtgatcctgagcgtgagccccggcgagagagtgagcttcagctgcagagccagccagagcatcggcaccaacatccactggtaccagcagagaaccaacggcagccccagactgctgatcaagtacgccagcgagagcatcagcggcatccccagcagattcagcggcagcggcagcggcaccgacttcaccctgagcatcaacagcgtggagagcgaggacatcgccgactactactgccagcagaacaacaactggcccaccaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30726 - RNA, 675 nt, synthetic construct
  misc_feature 1..675: note = derived and/or modified sequence opt4 from Citatuzumab_bogatox_HeavyChain1
  source 1..675: mol_type = other RNA
caccaccaccaccaccacgaggtgcagctggtgcagagcggccccggcctggtgcagcccggcggcagcgtgagaatcagctgcgccgccagcggctacaccttcaccaactacggcatgaactgggtgaagcaggcccccggcaagggcctggagtggatgggctggatcaacacctacaccggcgagagcacctacgccgacagcttcaagggcagattcaccttcagcctggacaccagcgccagcgccgcctacctgcagatcaacagcctgagagccgaggacaccgccgtgtactactgcgccagattcgccatcaagggcgactactggggccagggcaccctgctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 30727 - RNA, 1443 nt, synthetic construct
  misc_feature 1..1443: note = derived and/or modified sequence opt4 from Citatuzumab_bogatox_LightChain1
  source 1..1443: mol_type = other RNA
gacatccagatgacccagagccccagcagcctgagcgccagcgtgggcgacagagtgaccatcacctgcagaagcaccaagagcctgctgcacagcaacggcatcacctacctgtactggtaccagcagaagcccggcaaggcccccaagctgctgatctaccagatgagcaacctggccagcggcgtgcccagcagattcagcagcagcggcagcggcaccgacttcaccctgaccatcagcagcctgcagcccgaggacttcgccacctactactgcgcccagaacctggagatccccagaaccttcggccagggcaccaaggtggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgcaccagacacagacagcccagaggctgggagcagctgtacaacaccgtgagcttcaacctgggcgaggcctacgagtaccccaccttcatccaggacctgagaaacgagctggccaagggcacccccgtgtgccagctgcccgtgaccctgcagaccatcgccgacgacaagagattcgtgctggtggacatcaccaccaccagcaagaagaccgtgaaggtggccatcgacgtgaccgacgtgtacgtggtgggctaccaggacaagtgggacggcaaggacagagccgtgttcctggacaaggtgcccaccgtggccaccagcaagctgttccccggcgtgaccaacagagtgaccctgaccttcgacggcagctaccagaagctggtgaacgccgccaaggccgacagaaaggccctggagctgggcgtgaacaagctggagttcagcatcgaggccatccacggcaagaccatcaacggccaggaggccgccaagttcttcctgatcgtgatccagatggtgagcgaggccgccagattcaagtacatcgagaccgaggtggtggacagaggcctgtacggcagcttcaagcccaacttcaaggtgctgaacctggagaacaactggggcgacatcagcgacgccatccacaagagcagcccccagtgcaccaccatcaaccccgccctgcagctgatcagccccagcaacgacccctgggtggtgaacaaggtgagccagatcagccccgacatgggcatcctgaagttcaagagcagcaag

SEQ ID NO: 30728 - RNA, 1380 nt, synthetic construct
  misc_feature 1..1380: note = derived and/or modified sequence opt4 from Cixutumumab_HeavyChain1
  source 1..1380: mol_type = other RNA
gaggtgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatccccatcttcggcaccgccaactacgcccagaagttccagggcagagtgaccatcaccgccgacaagagcaccagcaccgcctacatggagctgagcagcctgagaagcgaggacaccgccgtgtactactgcgccagagcccccctgagattcctggagtggagcacccaggaccactactactactactacatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30729 - RNA, 642 nt, synthetic construct
  misc_feature 1..642: note = derived and/or modified sequence opt4 from Cixutumumab_LightChain1
  source 1..642: mol_type = other RNA
agcagcgagctgacccaggaccccgccgtgagcgtggccctgggccagaccgtgagaatcacctgccagggcgacagcctgagaagctactacgccacctggtaccagcagaagcccggccaggcccccatcctggtgatctacggcgagaacaagagacccagcggcatccccgacagattcagcggcagcagcagcggcaacaccgccagcctgaccatcaccggcgcccaggccgaggacgaggccgactactactgcaagagcagagacggcagcggccagcacctggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccgccgagtgcagc

SEQ ID NO: 30730 - RNA, 1350 nt, synthetic construct
  misc_feature 1..1350: note = derived and/or modified sequence opt4 from Clazakizumab_HeavyChain1
  source 1..1350: mol_type = other RNA
gaggtgcagctggtggagagcggcggcggcctggtgcagcccggcggcagcctgagactgagctgcgccgccagcggcttcagcctgagcaactactacgtgacctgggtgagacaggcccccggcaagggcctggagtgggtgggcatcatctacggcagcgacgagaccgcctacgccaccagcgccatcggcagattcaccatcagcagagacaacagcaagaacaccctgtacctgcagatgaacagcctgagagccgaggacaccgccgtgtactactgcgccagagacgacagcagcgactgggacgccaagttcaacctgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30731 - RNA, 651 nt, synthetic construct
  misc_feature 1..651: note = derived and/or modified sequence opt4 from Clazakizumab_LightChain1
  source 1..651: mol_type = other RNA
gccatccagatgacccagagccccagcagcctgagcgccagcgtgggcgacagagtgaccatcacctgccaggccagccagagcatcaacaacgagctgagctggtaccagcagaagcccggcaaggcccccaagctgctgatctacagagccagcaccctggccagcggcgtgcccagcagattcagcggcagcggcagcggcaccgacttcaccctgaccatcagcagcctgcagcccgacgacttcgccacctactactgccagcagggctacagcctgagaaacatcgacaacgccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30732 - RNA, 1347 nt, synthetic construct
  misc_feature 1..1347: note = derived and/or modified sequence opt4 from Clivatuzumab_tetraxetan_HeavyChain1
  source 1..1347: mol_type = other RNA
caggtgcagctgcagcagagcggcgccgaggtgaagaagcccggcgccagcgtgaaggtgagctgcgaggccagcggctacaccttccccagctacgtgctgcactgggtgaagcaggcccccggccagggcctggagtggatcggctacatcaacccctacaacgacggcacccagtacaacgagaagttcaagggcaaggccaccctgaccagagacaccagcatcaacaccgcctacatggagctgagcagactgagaagcgacgacaccgccgtgtactactgcgccagaggcttcggcggcagctacggcttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30733 - RNA, 645 nt, synthetic construct
  misc_feature 1..645: note = derived and/or modified sequence opt4 from Clivatuzumab_tetraxetan_LightChain1
  source 1..645: mol_type = other RNA
gacatccagctgacccagagccccagcagcctgagcgccagcgtgggcgacagagtgaccatgacctgcagcgccagcagcagcgtgagcagcagctacctgtactggtaccagcagaagcccggcaaggcccccaagctgtggatctacagcaccagcaacctggccagcggcgtgcccgccagattcagcggcagcggcagcggcaccgacttcaccctgaccatcagcagcctgcagcccgaggacagcgccagctacttctgccaccagtggaacagatacccctacaccttcggcggcggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30734 - RNA, 1335 nt, synthetic construct
  misc_feature 1..1335: note = derived and/or modified sequence opt4 from Codrituzumab_HeavyChain1
  source 1..1335: mol_type = other RNA
caggtgcagctggtgcagagcggcgccgaggtgaagaagcccggcgccagcgtgaaggtgagctgcaaggccagcggctacaccttcaccgactacgagatgcactgggtgagacaggcccccggccagggcctggagtggatgggcgccctggaccccaagaccggcgacaccgcctacagccagaagttcaagggcagagtgaccctgaccgccgacaagagcaccagcaccgcctacatggagctgagcagcctgaccagcgaggacaccgccgtgtactactgcaccagattctacagctacacctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30735 - RNA, 657 nt, synthetic construct
  misc_feature 1..657: note = derived and/or modified sequence opt4 from Codrituzumab_LightChain1
  source 1..657: mol_type = other RNA
gacgtggtgatgacccagagccccctgagcctgcccgtgacccccggcgagcccgccagcatcagctgcagaagcagccagagcctggtgcacagcaacagaaacacctacctgcactggtacctgcagaagcccggccagagcccccagctgctgatctacaaggtgagcaacagattcagcggcgtgcccgacagattcagcggcagcggcagcggcaccgacttcaccctgaagatcagcagagtggaggccgaggacgtgggcgtgtactactgcagccagaacacccacgtgccccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30736 - RNA, 1350 nt, synthetic construct
  misc_feature 1..1350: note = derived and/or modified sequence opt4 from Coltuximab_ravtansine_HeavyChain1
  source 1..1350: mol_type = other RNA
caggtgcagctggtgcagcccggcgccgaggtggtgaagcccggcgccagcgtgaagctgagctgcaagaccagcggctacaccttcaccagcaactggatgcactgggtgaagcaggcccccggccagggcctggagtggatcggcgagatcgaccccagcgacagctacaccaactacaaccagaacttccagggcaaggccaagctgaccgtggacaagagcaccagcaccgcctacatggaggtgagcagcctgagaagcgacgacaccgccgtgtactactgcgccagaggcagcaacccctactactacgccatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30737 - RNA, 633 nt, synthetic construct
  misc_feature 1..633: note = derived and/or modified sequence opt4 from Coltuximab_ravtansine_LightChain1
  source 1..633: mol_type = other RNA
gagatcgtgctgacccagagccccgccatcatgagcgccagccccggcgagagagtgaccatgacctgcagcgccagcagcggcgtgaactacatgcactggtaccagcagaagcccggcaccagccccagaagatggatctacgacaccagcaagctggccagcggcgtgcccgccagattcagcggcagcggcagcggcaccgactacagcctgaccatcagcagcatggagcccgaggacgccgccacctactactgccaccagagaggcagctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30738 - RNA, 1356 nt, synthetic construct
  misc_feature 1..1356: note = derived and/or modified sequence opt4 from Conatumumab_CV_HeavyChain
  source 1..1356: mol_type = other RNA
caggtgcagctgcaggagagcggccccggcctggtgaagcccagccagaccctgagcctgacctgcaccgtgagcggcggcagcatcagcagcggcgactacttctggagctggatcagacagctgcccggcaagggcctggagtggatcggccacatccacaacagcggcaccacctactacaaccccagcctgaagagcagagtgaccatcagcgtggacaccagcaagaagcagttcagcctgagactgagcagcgtgaccgccgccgacaccgccgtgtactactgcgccagagacagaggcggcgactactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30739 - RNA, 645 nt, synthetic construct
  misc_feature 1..645: note = derived and/or modified sequence opt4 from Conatumumab_CV_LightChain
  source 1..645: mol_type = other RNA
gagatcgtgctgacccagagccccggcaccctgagcctgagccccggcgagagagccaccctgagctgcagagccagccagggcatcagcagaagctacctggcctggtaccagcagaagcccggccaggcccccagcctgctgatctacggcgccagcagcagagccaccggcatccccgacagattcagcggcagcggcagcggcaccgacttcaccctgaccatcagcagactggagcccgaggacttcgccgtgtactactgccagcagttcggcagcagcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30740 - RNA, 1356 nt, synthetic construct; identical to SEQ ID NO: 30738
  misc_feature 1..1356: note = derived and/or modified sequence opt4 from Conatumumab_HeavyChain1
  source 1..1356: mol_type = other RNA

SEQ ID NO: 30741 - RNA, 1356 nt, synthetic construct; identical to SEQ ID NO: 30738
  misc_feature 1..1356: note = derived and/or modified sequence opt4 from Conatumumab_HeavyChain
  source 1..1356: mol_type = other RNA

SEQ ID NO: 30742 - RNA, 645 nt, synthetic construct; identical to SEQ ID NO: 30739
  misc_feature 1..645: note = derived and/or modified sequence opt4 from Conatumumab_LightChain1
  source 1..645: mol_type = other RNA

SEQ ID NO: 30743 - RNA, 645 nt, synthetic construct; identical to SEQ ID NO: 30739
  misc_feature 1..645: note = derived and/or modified sequence opt4 from Conatumumab_LightChain
  source 1..645: mol_type = other RNA

SEQ ID NO: 30744 - RNA, 1344 nt, synthetic construct
  misc_feature 1..1344: note = derived and/or modified sequence opt4 from Concizumab_HeavyChain1
  source 1..1344: mol_type = other RNA
gaggtgcagctggtggagagcggcggcggcctggtgaagcccggcggcagcctgagactgagctgcgccgccagcggcttcaccttcagcaactacgccatgagctgggtgagacagacccccgagaagagactggagtgggtggccaccatcagcagaagcggcagctacagctacttccccgacagcgtgcagggcagattcaccatcagcagagacaacgccaagaacagcctgtacctgcagatgaacagcctgagagccgaggacaccgccgtgtactactgcgccagactgggcggctacgacgagggcgacgccatggacagctggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30745 - RNA, 657 nt, synthetic construct
  misc_feature 1..657: note = derived and/or modified sequence opt4 from Concizumab_LightChain1
  source 1..657: mol_type = other RNA
gacatcgtgatgacccagacccccctgagcctgagcgtgacccccggccagcccgccagcatcagctgcaagagcagccagagcctgctggagagcgacggcaagacctacctgaactggtacctgcagaagcccggccagagcccccagctgctgatctacctggtgagcatcctggacagcggcgtgcccgacagattcagcggcagcggcagcggcaccgacttcaccctgaagatcagcagagtggaggccgaggacgtgggcgtgtactactgcctgcaggccacccacttcccccagaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30746 - RNA, 1314 nt, synthetic construct
  misc_feature 1..1314: note = derived and/or modified sequence opt4 from Crenezumab_HeavyChain1
  source 1..1314: mol_type = other RNA
gaggtgcagctggtggagagcggcggcggcctggtgcagcccggcggcagcctgagactgagctgcgccgccagcggcttcaccttcagcagctacggcatgagctgggtgagacaggcccccggcaagggcctggagctggtggccagcatcaacagcaacggcggcagcacctactaccccgacagcgtgaagggcagattcaccatcagcagagacaacgccaagaacagcctgtacctgcagatgaacagcctgagagccgaggacaccgccgtgtactactgcgccagcggcgactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 30747 - RNA, 657 nt, synthetic construct
  misc_feature 1..657: note = derived and/or modified sequence opt4 from Crenezumab_LightChain1
  source 1..657: mol_type = other RNA
gacatcgtgatgacccagagccccctgagcctgcccgtgacccccggcgagcccgccagcatcagctgcagaagcagccagagcctggtgtacagcaacggcgacacctacctgcactggtacctgcagaagcccggccagagcccccagctgctgatctacaaggtgagcaacagattcagcggcgtgcccgacagattcagcggcagcggcagcggcaccgacttcaccctgaagatcagcagagtggaggccgaggacgtgggcgtgtactactgcagccagagcacccacgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30748 - RNA, 1365 nt, synthetic construct
  misc_feature 1..1365: note = derived and/or modified sequence opt4 from Crotedumab_HeavyChain1
  source 1..1365: mol_type = other RNA
gaggtgcagctggtggagagcggcggcggcctggtgcagcccggcggcagcctgagactgagctgcgccgccagcggcttcaccttcagcaactacctgatgaactgggtgagacaggcccccggcaagggcctggagtggctggccaacatccaggaggacggcatcgagaagtactacgtggacagcgtgaagggcagattcaccatcagcagagacaacgccaagaacagcctgtacctgcagatgaacagcctgagagccgaggacaccgccgtgtactactgcgccagagagcccagccactacgacatcctgaccggctacgactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagcaacaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30749 - RNA, 1365 nt, synthetic construct
  misc_feature 1..1365: note = derived and/or modified sequence opt4 from Crotedumab_HeavyChain2
  source 1..1365: mol_type = other RNA
gaggtgcagctggtggagagcggcggcggcctggtgcagcccggcggcagcctgcacctgagctgcgccgccagcggcttcaccttcagcaactacctgatgaactgggtgagacaggcccccggcaagggcctggagtggctggccaacatccaggaggacggcatcgagaagtactacgtggacagcgtgaagggcagattcaccatcagcagagacaacgccaagaacagcctgtacctgcagatgaacagcctgagagccgaggacaccgccgtgtactactgcgccagagagcccagccactacgacatcctgaccggctacgactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagcaacaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccgaggtggacgagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttctggagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacgagagcagatggcaggagcacaacgtgttcagctgcagcgtgatgcacgaggccctgcacaaccactacacccagaagagcctgagcctgagcctgggcaag

SEQ ID NO: 30750 - RNA, 642 nt, synthetic construct
  misc_feature 1..642: note = derived and/or modified sequence opt4 from Crotedumab_LightChain1
  source 1..642: mol_type = other RNA
gacatccagatgacccagagccccagcagcctgagcgccagcgtgggcgacagagtgaccatcacctgcagagccagccagggcatcagaaacgacctgggctggtaccagcagaagcccggcaaggcccccaagagactgatctacgccgccagcagcctgcagagcggcgtgcccagcagattcagcggcagcggcagcggcaccgagttcatcctgaccgtgagcagcctgcagcccgaggacttcgccacctactactgcctgcagtacaacgagaaccccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgaggagcacaaggtgtacgcctgcgaggtgacccaccagggcctgagcagccccgtgaccaagagcttcaacagaggcgagtgc

SEQ ID NO: 30751 - RNA, 642 nt, synthetic construct
  misc_feature 1..642: note = derived and/or modified sequence opt4 from Crotedumab_LightChain2
  source 1..642: mol_type = other RNA
gacatccagatgacccagagccccagcagcctgagcgccagcgtgggcgacagagtgaccatcacctgcagagccagccagggcatcagaaacgacctgggctggtaccagcagaagcccggcaaggcccccaagagactgatctacgccgccagcagcctgcagagcggcgtgcccagcagattcagcggcagcggcagcggcaccgagttcatcctgaccgtgagcagcctgcagcccgaggacttcgccacctactactgcctgcagtacaacagcaaccccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagaacaaggtggacaacgccctgcagagcggcaacagccaggagagcgtgaccgagcaggacagcaaggacagcacctacagcctgagcagcaccctgaccctgagcgaggccgactacgagaagcacaaggtgtacgcctgcgaggtgacccaccagggcctgagcagccccgtgaccaagagcttcaacagaggcgagtgc

SEQ ID NO: 30752 - RNA, 1332 nt, synthetic construct
  misc_feature 1..1332: note = derived and/or modified sequence opt4 from Dacetuzumab_HeavyChain1
  source 1..1332: mol_type = other RNA
gaggtgcagctggtggagagcggcggcggcctggtgcagcccggcggcagcctgagactgagctgcgccgccagcggctacagcttcaccggctactacatccactgggtgagacaggcccccggcaagggcctggagtgggtggccagagtgatccccaacgccggcggcaccagctacaaccagaagttcaagggcagattcaccctgagcgtggacaacagcaagaacaccgcctacctgcagatgaacagcctgagagccgaggacaccgccgtgtactactgcgccagagagggcatctactggtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30753 - RNA, 657 nt, synthetic construct
  misc_feature 1..657: note = derived and/or modified sequence opt4 from Dacetuzumab_LightChain1
  source 1..657: mol_type = other RNA
gacatccagatgacccagagccccagcagcctgagcgccagcgtgggcgacagagtgaccatcacctgcagaagcagccagagcctggtgcacagcaacggcaacaccttcctgcactggtaccagcagaagcccggcaaggcccccaagctgctgatctacaccgtgagcaacagattcagcggcgtgcccagcagattcagcggcagcggcagcggcaccgacttcaccctgaccatcagcagcctgcagcccgaggacttcgccacctacttctgcagccagaccacccacgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30754 - RNA, 318 nt, synthetic construct
  misc_feature 1..318: note = derived and/or modified sequence opt4 from Dacliximab_LightChain_VJ-Region
  source 1..318: mol_type = other RNA
gacatccagatgacccagagccccagcaccctgagcgccagcgtgggcgacagagtgaccatcacctgcagcgccagcagcagcatcagctacatgcactggtaccagcagaagcccggcaaggcccccaagctgctgatctacaccaccagcaacctggccagcggcgtgcccgccagattcagcggcagcggcagcggcaccgagttcaccctgaccatcagcagcctgcagcccgacgacttcgccacctactactgccaccagagaagcacctaccccctgaccttcggccagggcaccaaggtggaggtgaag

SEQ ID NO: 30755 - RNA, 348 nt, synthetic construct
  misc_feature 1..348: note = derived and/or modified sequence opt4 from Dacliximab_gamma2-Chain_VDJ-Region
  source 1..348: mol_type = other RNA
caggtgcagctggtgcagagcggcgccgaggtgaagaagcccggcagcagcgtgaaggtgagctgcaaggccagcggctacaccttcaccagctacagaatgcactgggtgagacaggcccccggccagggcctggagtggatcggctacatcaaccccagcaccggctacaccgagtacaaccagaagttcaaggacaaggccaccatcaccgccgacgagagcaccaacaccgcctacatggagctgagcagcctgagaagcgaggacaccgccgtgtactactgcgccagaggcggcggcgtgttcgactactggggccagggcaccctggtgaccgtgagcagc

SEQ ID NO: 30756 - RNA, 1326 nt, synthetic construct
  misc_feature 1..1326: note = derived and/or modified sequence opt4 from Daclizumab_HeavyChain
  source 1..1326: mol_type = other RNA
caggtgcagctggtgcagagcggcgccgaggtgaagaagcccggcagcagcgtgaaggtgagctgcaaggccagcggctacaccttcaccagctacagaatgcactgggtgagacaggcccccggccagggcctggagtggatcggctacatcaaccccagcaccggctacaccgagtacaaccagaagttcaaggacaaggccaccatcaccgccgacgagagcaccaacaccgcctacatggagctgagcagcctgagaagcgaggacaccgccgtgtactactgcgccagaggcggcggcgtgttcgactactggggccagggcaccaccctgaccgtgagcagcggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30757 - RNA, 630 nt, synthetic construct
  misc_feature 1..630: note = derived and/or modified sequence opt4 from Daclizumab_LightChain
  source 1..630: mol_type = other RNA
gacatccagatgacccagagccccagcaccctgagcgccagcgtgggcgacagagtgaccatcacctgcagcgccagcagcagcatcagctacatgcactggtaccagcagaagcccggcaaggcccccaagctgctgatctacaccaccagcaacctggccagcggcgtgcccgccagattcagcggcagcggcagcggcaccgagttcaccctgaccatcagcagcctgcagcccgacgacttcgccacctactactgccaccagagaagcacctaccccctgaccttcggcagcggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 30758 - RNA, 1341 nt, synthetic construct
  misc_feature 1..1341: note = derived and/or modified sequence opt4 from Dalotuzumab_HeavyChain1
  source 1..1341: mol_type = other RNA
caggtgcagctgcagcagagcggccccggcctggtgaagcccagccagaccctgagcctgacctgcaccgtgagcggctggagcatcagcggcggctggctgtggaactggatcagacagccccccggcaagggcctgcagtggatcggctggatcagctgggacggcaccaacaactggaagcccagcctgaaggacagagtgaccatcagcgtggacaccagcaagaaccagttcagcctgaagctgagcagcgtgaccgccgccgacaccgccgtgtggtggtgcgccagatggggcagagtgttcttcgactggtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30759 - RNA, 657 nt, synthetic construct
  misc_feature 1..657: note = derived and/or modified sequence opt4 from Dalotuzumab_LightChain1
  source 1..657: mol_type = other RNA
gacatcgtgatgacccagagccccctgagcctgcccgtgacccccggccagcccgccagcatcagctgcagaagcagccagagcatcgtgcacagcaacggcaacacctggctgcagtggtggctgcagaagcccggccagagcccccagctgctgatctggaaggtgagcaacagactgtggggcgtgcccgacagattcagcggcagcggcagcggcaccgacttcaccctgaagatcagcagagtgcaggcccaggacgtgggcgtgtggtggtgcttccagggcagccacgtgccctggaccttcggccagggcaccaaggtgcagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30760 - RNA, 687 nt, synthetic construct
  misc_feature 1..687: note = derived and/or modified sequence opt4 from Dapirolizumab_pegol_HeavyChain1
  source 1..687: mol_type = other RNA
gaggtgcagctggtggagagcggcggcggcctggtgcagcccggcggcagcctgagactgagctgcgccgtgagcggcttcagcagcaccaactaccacgtgcactgggtgagacaggcccccggcaagggcctggagtggatgggcgtgatctggggcgacggcgacaccagctacaacagcgtgctgaagagcagattcaccatcagcagagacaccagcaagaacaccgtgtacctgcagatgaacagcctgagagccgaggacaccgccgtgtactactgcgccagacagctgacccactactacgtgctggccgcctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgcgccgcc

SEQ ID NO: 30761 - RNA, 642 nt, synthetic construct
  misc_feature 1..642: note = derived and/or modified sequence opt4 from Dapirolizumab_pegol_LightChain1
  source 1..642: mol_type = other RNA
gacatccagatgacccagagccccagcagcctgagcgccagcgtgggcgacagagtgaccatcacctgcagagccagcgaggacctgtactacaacctggcctggtaccagagaaagcccggcaaggcccccaagctgctgatctacgacacctacagactggccgacggcgtgcccagcagattcagcggcagcggcagcggcaccgactacaccctgaccatcagcagcctgcagcccgaggacttcgccagctactactgccagcagtactacaagttccccttcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30762 - RNA, 1356 nt, synthetic construct
  misc_feature 1..1356: note = derived and/or modified sequence opt4 from Daratumumab_HeavyChain1
  source 1..1356: mol_type = other RNA
gaggtgcagctgctggagagcggcggcggcctggtgcagcccggcggcagcctgagactgagctgcgccgtgagcggcttcaccttcaacagcttcgccatgagctgggtgagacaggcccccggcaagggcctggagtgggtgagcgccatcagcggcagcggcggcggcacctactacgccgacagcgtgaagggcagattcaccatcagcagagacaacagcaagaacaccctgtacctgcagatgaacagcctgagagccgaggacaccgccgtgtacttctgcgccaaggacaagatcctgtggttcggcgagcccgtgttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30763 - RNA, 642 nt, synthetic construct
  misc_feature 1..642: note = derived and/or modified sequence opt4 from Daratumumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30764 - RNA, 1350 nt, synthetic construct
  misc_feature 1..1350: note = derived and/or modified sequence opt4 from Dectrekumab_HeavyChain1
  source 1..1350: mol_type = other RNA
gaggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccatcatctggtacgacggcagcaacaagtactacgccgacagcgtgaagggcagattcaccatcagcagagacaacagcaagaacaccctgtacctgcagatgaacagcctgagagccgaggacaccgccgtgtactactgcgccagactgtggttcggcgacctggacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30765 - RNA, 648 nt, synthetic construct
  misc_feature 1..648: note = derived and/or modified sequence opt4 from Dectrekumab_LightChain1
  source 1..648: mol_type = other RNA
gagatcgtgctgacccagagccccgccaccctgagcctgagccccggcgagagagccatcctgagctgcagagccggccagagcgtgagcagctacctggtgtggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcagctggccccccgtgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30766 - RNA, 1332 nt, synthetic construct
  misc_feature 1..1332: note = derived and/or modified sequence opt4 from Demcizumab_HeavyChain1
  source 1..1332: mol_type = other RNA
caggtgcagctggtgcagagcggcgccgaggtgaagaagcccggcgccagcgtgaagatcagctgcaaggccagcggctacagcttcaccgcctactacatccactgggtgaagcaggcccccggccagggcctggagtggatcggctacatcagcagctacaacggcgccaccaactacaaccagaagttcaagggcagagtgaccttcaccaccgacaccagcaccagcaccgcctacatggagctgagaagcctgagaagcgacgacaccgccgtgtactactgcgccagagactacgactacgacgtgggcatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30767 - RNA, 654 nt, synthetic construct
  misc_feature 1..654: note = derived and/or modified sequence opt4 from Demcizumab_LightChain1
  source 1..654: mol_type = other RNA
gacatcgtgatgacccagagccccgacagcctggccgtgagcctgggcgagagagccaccatcagctgcagagccagcgagagcgtggacaactacggcatcagcttcatgaagtggttccagcagaagcccggccagccccccaagctgctgatctacgccgccagcaaccagggcagcggcgtgcccgacagattcagcggcagcggcagcggcaccgacttcaccctgaccatcagcagcctgcaggccgaggacgtggccgtgtactactgccagcagagcaaggaggtgccctggaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30768 - RNA, 1350 nt, synthetic construct
  misc_feature 1..1350: note = derived and/or modified sequence opt4 from Denintuzumab_mafodotin_HeavyChain1
  source 1..1350: mol_type = other RNA
caggtgcagctgcaggagagcggccccggcctggtgaagcccagccagaccctgagcctgacctgcaccgtgagcggcggcagcatcagcaccagcggcatgggcgtgggctggatcagacagcaccccggcaagggcctggagtggatcggccacatctggtgggacgacgacaagagatacaaccccgccctgaagagcagagtgaccatcagcgtggacaccagcaagaaccagttcagcctgaagctgagcagcgtgaccgccgccgacaccgccgtgtactactgcgccagaatggagctgtggagctactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30769 - RNA, 639 nt, synthetic construct
  misc_feature 1..639: note = derived and/or modified sequence opt4 from Denintuzumab_mafodotin_LightChain1
  source 1..639: mol_type = other RNA
gagatcgtgctgacccagagccccgccaccctgagcctgagccccggcgagagagccaccctgagctgcagcgccagcagcagcgtgagctacatgcactggtaccagcagaagcccggccaggcccccagactgctgatctacgacaccagcaagctggccagcggcatccccgccagattcagcggcagcggcagcggcaccgacttcaccctgaccatcagcagcctggagcccgaggacgtggccgtgtactactgcttccagggcagcgtgtaccccttcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30770 - RNA, 1356 nt, synthetic construct
  misc_feature 1..1356: note = derived and/or modified sequence opt4 from Denosumab_HeavyChain
  source 1..1356: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtgagcggcatcaccggcagcggcggcagcacctactacgccgacagcgtgaagggcagattcaccatcagcagagacaacagcaagaacaccctgtacctgcagatgaacagcctgagagccgaggacaccgccgtgtactactgcgccaaggaccccggcaccaccgtgatcatgagctggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30771 - RNA, 645 nt, synthetic construct
  misc_feature 1..645: note = derived and/or modified sequence opt4 from Denosumab_LightChain
  source 1..645: mol_type = other RNA
gagatcgtgctgacccagagccccggcaccctgagcctgagccccggcgagagagccaccctgagctgcagagccagccagagcgtgagaggcagatacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgttctactgccagcagtacggcagcagccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30772 - RNA, 1338 nt, synthetic construct
  misc_feature 1..1338: note = derived and/or modified sequence opt4 from Depatuxizumab_HeavyChain1
  source 1..1338: mol_type = other RNA
caggtgcagctgcaggagagcggccccggcctggtgaagcccagccagaccctgagcctgacctgcaccgtgagcggctacagcatcagcagcgacttcgcctggaactggatcagacagccccccggcaagggcctggagtggatgggctacatcagctacagcggcaacaccagataccagcccagcctgaagagcagaatcaccatcagcagagacaccagcaagaaccagttcttcctgaagctgaacagcgtgaccgccgccgacaccgccacctactactgcgtgaccgccggcagaggcttcccctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30773 - RNA, 642 nt, synthetic construct
  misc_feature 1..642: note = derived and/or modified sequence opt4 from Depatuxizumab_LightChain1
  source 1..642: mol_type = other RNA
gacatccagatgacccagagccccagcagcatgagcgtgagcgtgggcgacagagtgaccatcacctgccacagcagccaggacatcaacagcaacatcggctggctgcagcagaagcccggcaagagcttcaagggcctgatctaccacggcaccaacctggacgacggcgtgcccagcagattcagcggcagcggcagcggcaccgactacaccctgaccatcagcagcctgcagcccgaggacttcgccacctactactgcgtgcagtacgcccagttcccctggaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30774 - RNA, 1338 nt, synthetic construct; identical to SEQ ID NO: 30772
  misc_feature 1..1338: note = derived and/or modified sequence opt4 from Depatuxizumab_mafodotin_HeavyChain1
  source 1..1338: mol_type = other RNA

SEQ ID NO: 30775 - RNA, 642 nt, synthetic construct; identical to SEQ ID NO: 30773
  misc_feature 1..642: note = derived and/or modified sequence opt4 from Depatuxizumab_mafodotin_LightChain1
  source 1..642: mol_type = other RNA

SEQ ID NO: 30776 - RNA, 1329 nt, synthetic construct
  misc_feature 1..1329: note = derived and/or modified sequence opt4 from Dinutuximab_beta_HeavyChain1
  source 1..1329: mol_type = other RNA
gaggtgcagctgctgcagagcggccccgagctggagaagcccggcgccagcgtgatgatcagctgcaaggccagcggcagcagcttcaccggctacaacatgaactgggtgagacagaacatcggcaagagcctggagtggatcggcgccatcgacccctactacggcggcaccagctacaaccagaagttcaagggcagagccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30777 - RNA, 660 nt, synthetic construct
  misc_feature 1..660: note = derived and/or modified sequence opt4 from Dinutuximab_beta_LightChain1
  source 1..660: mol_type = other RNA
gagatcgtgatgacccagagccccgccaccctgagcgtgagccccggcgagagagccaccctgagctgcagaagcagccagagcctggtgcacagaaacggcaacacctacctgcactggtacctgcagaagcccggccagagccccaagctgctgatccacaaggtgagcaacagattcagcggcgtgcccgacagattcagcggcagcggcagcggcaccgacttcaccctgaagatcagcagagtggaggccgaggacctgggcgtgtacttctgcagccagagcacccacgtgccccccctgaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30778 - RNA, 1329 nt, synthetic construct; identical to SEQ ID NO: 30776
  misc_feature 1..1329: note = derived and/or modified sequence opt4 from Dinutuximab_HeavyChain1
  source 1..1329: mol_type = other RNA

SEQ ID NO: 30779 - RNA, 660 nt, synthetic construct; identical to SEQ ID NO: 30777
  misc_feature 1..660: note = derived and/or modified sequence opt4 from Dinutuximab_LightChain1
  source 1..660: mol_type = other RNA

SEQ ID NO: 30780 - RNA, 660 nt, synthetic construct; identical to SEQ ID NO: 30777
  misc_feature 1..660: note = derived and/or modified sequence opt4 from Dinutuximab_LightChain
  source 1..660: mol_type = other RNA

SEQ ID NO: 30781 - RNA, 1350 nt, synthetic construct
  misc_feature 1..1350: note = derived and/or modified sequence opt4 from Diridavumab_HeavyChain1
  source 1..1350: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30782 - RNA, 651 nt, synthetic construct
  misc_feature 1..651: note = derived and/or modified sequence opt4 from Diridavumab_LightChain1
  source 1..651: mol_type = other RNA
cagagcgtgctgacccagccccccagcgtgagcgccgcccccggccagaaggtgaccatcagctgcagcggcagcagcagcaacatcggcaacgactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccaactactactgcgccacctgggacagaagacccaccgcctacgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30783 - RNA, 1338 nt, synthetic construct
  misc_feature 1..1338: note = derived and/or modified sequence opt4 from Domagrozumab_HeavyChain1
  source 1..1338: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtgagcaccatcagcagcggcggcagctacaccagctaccccgacagcgtgaagggcagattcaccatcagcagagacaacagcaagaacaccctgtacctgcagatgaacagcctgagagccgaggacaccgccgtgtactactgcgccaagcaggactacgccatgaactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30784 - RNA, 1335 nt, synthetic construct
  misc_feature 1..1335: note = derived and/or modified sequence opt4 from Domagrozumab_HeavyChain
  source 1..1335: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtgagcaccatcagcagcggcggcagctacaccagctaccccgacagcgtgaagggcagattcaccatcagcagagacaacagcaagaacaccctgtacctgcagatgaacagcctgagagccgaggacaccgccgtgtactactgcgccaagcaggactacgccatgaactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30785 - RNA, 642 nt, synthetic construct
  misc_feature 1..642: note = derived and/or modified sequence opt4 from Domagrozumab_LightChain1
  source 1..642: mol_type = other RNA
gacatccagatgacccagagccccagcagcctgagcgccagcgtgggcgacagagtgaccatcacctgcaaggccagccaggacgtgagcaccgccgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagcactacagcaccccctggaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30786 - RNA, 1335 nt, synthetic construct
  misc_feature 1..1335: note = derived and/or modified sequence opt4 from Drozituab_HeavyChain1
  source 1..1335: mol_type = other RNA
gaggtgcagctggtgcagagcggcggcggcgtggagagacccggcggcagcctgagactgagctgcgccgccagcggcttcaccttcgacgactacgccagctgggtgagacaggcccccggcaagggcctggagtgggtgagcggcatcaactggcagggcggcagcaccggctacgccgacagcgtgaagggcagagtgaccatcagcagagacaacgccaagaacagcctgtacctgcagaacagcctgagagccgaggacaccgccgtgtactactgcgccaagatcctgggcgccggcagaggctggtacttcgactactggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 30787 - RNA, 639 nt, synthetic construct
  misc_feature 1..639: note = derived and/or modified sequence opt4 from Drozituab_LightChain1
  source 1..639: mol_type = other RNA
agcgagctgacccaggaccccgccgtgagcgtggccctgggccagaccgtgagaatcacctgcagcggcgacagcctgagaagctactacgccagctggtaccagcagaagcccggccaggcccccgtgctggtgatctacggcgccaacaacagacccagcggcatccccgacagattcagcggcagcagcagcggcaacaccgccagcctgaccatcaccggcgcccaggccgaggacgaggccgactactactgcaacagcgccgacagcagcggcaaccacgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 30788 - RNA, 1353 nt, synthetic construct
  misc_feature 1..1353: note = derived and/or modified sequence opt4 from Drozitumab_HeavyChain1
  source 1..1353: mol_type = other RNA
gaggtgcagctggtgcagagcggcggcggcgtggagagacccggcggcagcctgagactgagctgcgccgccagcggcttcaccttcgacgactacgccatgagctgggtgagacaggcccccggcaagggcctggagtgggtgagcggcatcaactggcagggcggcagcaccggctacgccgacagcgtgaagggcagagtgaccatcagcagagacaacgccaagaacagcctgtacctgcagatgaacagcctgagagccgaggacaccgccgtgtactactgcgccaagatcctgggcgccggcagaggctggtacttcgactactggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30789 - RNA, 639 nt, synthetic construct; identical to SEQ ID NO: 30787
  misc_feature 1..639: note = derived and/or modified sequence opt4 from Drozitumab_LightChain1
  source 1..639: mol_type = other RNA

SEQ ID NO: 30790 - RNA, 1353 nt, synthetic construct
  misc_feature 1..1353: note = derived and/or modified sequence opt4 from Duligotumab_HeavyChain1
  source 1..1353: mol_type = other RNA
gaggtgcagctggtggagagcggcggcggcctggtgcagcccggcggcagcctgagactgagctgcgccgccagcggcttcaccctgagcggcgactggatccactgggtgagacaggcccccggcaagggcctggagtgggtgggcgagatcagcgccgccggcggctacaccgactacgccgacagcgtgaagggcagattcaccatcagcgccgacaccagcaagaacaccgcctacctgcagatgaacagcctgagagccgaggacaccgccgtgtactactgcgccagagagagcagagtgagcttcgaggccgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30791 - RNA, 642 nt, synthetic construct
  misc_feature 1..642: note = derived and/or modified sequence opt4 from Duligotumab_LightChain1
  source 1..642: mol_type = other RNA
gacatccagatgacccagagccccagcagcctgagcgccagcgtgggcgacagagtgaccatcacctgcagagccagccagaacatcgccaccgacgtggcctggtaccagcagaagcccggcaaggcccccaagctgctgatctacagcgccagcttcctgtacagcggcgtgcccagcagattcagcggcagcggcagcggcaccgacttcaccctgaccatcagcagcctgcagcccgaggacttcgccacctactactgccagcagagcgagcccgagccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30792 - RNA, 1353 nt, synthetic construct; identical to SEQ ID NO: 30790
  misc_feature 1..1353: note = derived and/or modified sequence opt4 from Duligotuzumab_HeavyChain1
  source 1..1353: mol_type = other RNA

SEQ ID NO: 30793 - RNA, 642 nt, synthetic construct; identical to SEQ ID NO: 30791
  misc_feature 1..642: note = derived and/or modified sequence opt4 from Duligotuzumab_LightChain1
  source 1..642: mol_type = other RNA

SEQ ID NO: 30794 - RNA, 1353 nt, synthetic construct
  misc_feature 1..1353: note = derived and/or modified sequence opt4 from Dupilumab_HeavyChain1
  source 1..1353: mol_type = other RNA
gaggtgcagctggtggagagcggcggcggcctggagcagcccggcggcagcctgagactgagctgcgccggcagcggcttcaccttcagagactacgccatgacctgggtgagacaggcccccggcaagggcctggagtgggtgagcagcatcagcggcagcggcggcaacacctactacgccgacagcgtgaagggcagattcaccatcagcagagacaacagcaagaacaccctgtacctgcagatgaacagcctgagagccgaggacaccgccgtgtactactgcgccaaggacagactgagcatcaccatcagacccagatactacggcctggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 30795 - RNA, 657 nt, synthetic construct
  misc_feature 1..657: note = derived and/or modified sequence opt4 from Dupilumab_LightChain1
  source 1..657: mol_type = other RNA
gacatcgtgatgacccagagccccctgagcctgcccgtgacccccggcgagcccgccagcatcagctgcagaagcagccagagcctgctgtacagcatcggctacaactacctggactggtacctgcagaagagcggccagagcccccagctgctgatctacctgggcagcaacagagccagcggcgtgcccgacagattcagcggcagcggcagcggcaccgacttcaccctgaagatcagcagagtggaggccgaggacgtgggcttctactactgcatgcaggccctgcagaccccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30796 - RNA, 1353 nt, synthetic construct
  misc_feature 1..1353: note = derived and/or modified sequence opt4 from Durvalumab_HeavyChain1
  source 1..1353: mol_type = other RNA
gaggtgcagctggtggagagcggcggcggcctggtgcagcccggcggcagcctgagactgagctgcgccgccagcggcttcaccttcagcagatactggatgagctgggtgagacaggcccccggcaagggcctggagtgggtggccaacatcaagcaggacggcagcgagaagtactacgtggacagcgtgaagggcagattcaccatcagcagagacaacgccaagaacagcctgtacctgcagatgaacagcctgagagccgaggacaccgccgtgtactactgcgccagagagggcggctggttcggcgagctggccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagttcgagggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgccagcatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30797 - RNA, 645 nt, synthetic construct
  misc_feature 1..645: note = derived and/or modified sequence opt4 from Durvalumab_LightChain1
  source 1..645: mol_type = other RNA
gagatcgtgctgacccagagccccggcaccctgagcctgagccccggcgagagagccaccctgagctgcagagccagccagagagtgagcagcagctacctggcctggtaccagcagaagcccggccaggcccccagactgctgatctacgacgccagcagcagagccaccggcatccccgacagattcagcggcagcggcagcggcaccgacttcaccctgaccatcagcagactggagcccgaggacttcgccgtgtactactgccagcagtacggcagcctgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30798 - RNA, 1338 nt, synthetic construct
  misc_feature 1..1338: note = derived and/or modified sequence opt4 from Dusigitumab_HeavyChain1
  source 1..1338: mol_type = other RNA
caggtgcagctggtgcagagcggcgccgaggtgaagaagcccggcgccagcgtgaaggtgagctgcaaggccagcggctacaccttcaccagctacgacatcaactgggtgagacaggccaccggccagggcctggagtggatgggctggatgaaccccaacagcggcaacaccggctacgcccagaagttccagggcagagtgaccatgaccagaaacaccagcatcagcaccgcctacatggagctgagcagcctgagaagcgaggacaccgccgtgtactactgcgccagagacccctactactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30799 - RNA, 651 nt, synthetic construct
  misc_feature 1..651: note = derived and/or modified sequence opt4 from Dusigitumab_LightChain1
  source 1..651: mol_type = other RNA
cagagcgtgctgacccagccccccagcgtgagcgccgcccccggccagaaggtgaccatcagctgcagcggcagcagcagcaacatcgagaacaaccacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcgagacctgggacaccagcctgagcgccggcagagtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30800 - RNA, 1347 nt, synthetic construct
  misc_feature 1..1347: note = derived and/or modified sequence opt4 from Ecromeximab_HeavyChain1
  source 1..1347: mol_type = other RNA
gaggtgaccctggtggagagcggcggcgacttcgtgaagcccggcggcagcctgaaggtgagctgcgccgccagcggcttcgccttcagccactacgccatgagctgggtgagacagacccccgccaagagactggagtgggtggcctacatcagcagcggcggcagcggcacctactacagcgacagcgtgaagggcagattcaccatcagcagagacaacgccaagaacaccctgtacctgcagatgagaagcctgagaagcgaggacagcgccatgtacttctgcaccagagtgaagctgggcacctactacttcgacagctggggccagggcaccaccctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30801 - RNA, 642 nt, synthetic construct
  misc_feature 1..642: note = derived and/or modified sequence opt4 from Ecromeximab_LightChain1
  source 1..642: mol_type = other RNA
gacatccagatgacccagaccgccagcagcctgcccgccagcctgggcgacagagtgaccatcagctgcagcgccagccaggacatcagcaactacctgaactggtaccagcagaagcccgacggcaccgtgaagctgctgatcttctacagcagcaacctgcacagcggcgtgcccagcagattcagcggcggcggcagcggcaccgactacagcctgaccatcagcaacctggagcccgaggacatcgccacctacttctgccaccagtacagcaagctgccctggaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30802 - RNA, 1341 nt, synthetic construct
  misc_feature 1..1341: note = derived and/or modified sequence opt4 from Eculizumab_HeavyChain1
  source 1..1341: mol_type = other RNA
gtgcagctggtgcagagcggcgccgaggtgaagaagcccggcgccagcgtgaaggtgagctgcaaggccagcggctacatcttcagcaactactggatccagtgggtgagacaggcccccggccagggcctggagtggatgggcgagatcctgcccggcagcggcagcaccgagtacaccgagaacttcaaggacagagtgaccatgaccagagacaccagcaccagcaccgtgtacatggagctgagcagcctgagaagcgaggacaccgccgtgtactactgcgccagatacttcttcggcagcagccccaactggtacttcgacgtgtggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30803 - RNA, 642 nt, synthetic construct
  misc_feature 1..642: note = derived and/or modified sequence opt4 from Eculizumab_LightChain1
  source 1..642: mol_type = other RNA
gacatccagatgacccagagccccagcagcctgagcgccagcgtgggcgacagagtgaccatcacctgcggcgccagcgagaacatctacggcgccctgaactggtaccagcagaagcccggcaaggcccccaagctgctgatctacggcgccaccaacctggccgacggcgtgcccagcagattcagcggcagcggcagcggcaccgacttcaccctgaccatcagcagcctgcagcccgaggacttcgccacctactactgccagaacgtgctgaacacccccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30804 - RNA, 375 nt, synthetic construct
  misc_feature 1..375: note = derived and/or modified sequence opt4 from Efalizumab_HeavyChain
  source 1..375: mol_type = other RNA
gaggtgcagctggtggagagcggcggcggcctggtgcagcccggcggcagcctgagactgagctgcgccgccagcggctacagcttcaccggccactggatgaactgggtgagacaggcccccggcaagggcctggagtgggtgggcatcatgatccaccccagcgacagcgagaccagatacaaccagaagttcaaggacatcagattcaccatcagcgtggacaagagcaagaacaccctgtacctgcagatgaacagcctgagagccgaggacaccgccgtgtactactgcgccagaatcggcatctacttctacggcaccacctacttcgactacatctggggccagggcaccctggtgaccgtgagcagc

SEQ ID NO: 30805 - RNA, 324 nt, synthetic construct
  misc_feature 1..324: note = derived and/or modified sequence opt4 from Efalizumab_LightChain
  source 1..324: mol_type = other RNA
gacatccagatgacccagagccccagcagcctgagcgccagcgtgggcgacagagtgaccatcacctgcagagccagcaagaccatcagcaagtacctggcctggtaccagcagaagcccggcaaggcccccaagctgctgatctacagcggcagcaccctgcagagcggcgtgcccagcagattcagcggcagcggcagcggcaccgacttcaccctgaccatcagcagcctgcagcccgaggacttcgccacctactactgccagcagcacaacgagtaccccctgaccttcggccagggcaccaaggtggagatcaagaga

SEQ ID NO: 30806 - RNA, 768 nt, synthetic construct
  misc_feature 1..768: note = derived and/or modified sequence opt4 from Efungumab_SingleChain_variable_fragment
  source 1..768: mol_type = other RNA
atggccgaggtgcagctggtggagagcggcgccgaggtgaagaagcccggcgagagcctgagaatcagctgcaagggcagcggctgcatcatcagcagctactggatcagctgggtgagacagatgcccggcaagggcctggagtggatgggcaagatcgaccccggcgacagctacatcaactacagccccagcttccagggccacgtgaccatcagcgccgacaagagcatcaacaccgcctacctgcagtggaacagcctgaaggccagcgacaccgccatgtactactgcgccagaggcggcagagacttcggcgacagcttcgactactggggccagggcaccctggtgaccgtgagcagcggcggcggcggcagcggcggcggcggcagcggcggcggcggcagcgacgtggtgatgacccagagccccagcttcctgagcgccttcgtgggcgacagaatcaccatcacctgcagagccagcagcggcatcagcagatacctggcctggtaccagcaggcccccggcaaggcccccaagctgctgatctacgccgccagcaccctgcagaccggcgtgcccagcagattcagcggcagcggcagcggcaccgagttcaccctgaccatcaacagcctgcagcccgaggacttcgccacctactactgccagcacctgaacagctaccccctgaccttcggcggcggcaccaaggtggacatcaagagagccgccgccctggagcaccaccaccaccaccac

SEQ ID NO: 30807 - RNA, 1362 nt, synthetic construct
  misc_feature 1..1362: note = derived and/or modified sequence opt4 from Eldelumab_HeavyChain1
  source 1..1362: mol_type = other RNA
cagatgcagctggtggagagcggcggcggcgtggtgcagcccggcagaagcctgagactgagctgcaccgccagcggcttcaccttcagcaacaacggcatgcactgggtgagacaggcccccggcaagggcctggagtgggtggccgtgatctggttcgacggcatgaacaagttctacgtggacagcgtgaagggcagattcaccatcagcagagacaacagcaagaacaccctgtacctggagatgaacagcctgagagccgaggacaccgccatctactactgcgccagagagggcgacggcagcggcatctactactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30808 - RNA, 648 nt, synthetic construct
  misc_feature 1..648: note = derived and/or modified sequence opt4 from Eldelumab_LightChain1
  source 1..648: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccatcttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30809 - RNA, 1341 nt, synthetic construct
  misc_feature 1..1341: note = derived and/or modified sequence opt4 from Elgemtumab_HeavyChain1
  source 1..1341: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtgagcgccatcaacagccagggcaagagcacctactacgccgacagcgtgaagggcagattcaccatcagcagagacaacagcaagaacaccctgtacctgcagatgaacagcctgagagccgaggacaccgccgtgtactactgcgccagatggggcgacgagggcttcgacatctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30810 - RNA, 642 nt, synthetic construct
  misc_feature 1..642: note = derived and/or modified sequence opt4 from Elgemtumab_LightChain1
  source 1..642: mol_type = other RNA
gacatccagatgacccagagccccagcagcctgagcgccagcgtgggcgacagagtgaccatcacctgcagagccagccagggcatcagcaactggctggcctggtaccagcagaagcccggcaaggcccccaagctgctgatctacggcgccagcagcctgcagagcggcgtgcccagcagattcagcggcagcggcagcggcaccgacttcaccctgaccatcagcagcctgcagcccgaggacttcgccacctactactgccagcagtacagcagcttccccaccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30811 - RNA, 1347 nt, synthetic construct
  misc_feature 1..1347: note = derived and/or modified sequence opt4 from Elotuzumab_HeavyChain1
  source 1..1347: mol_type = other RNA
gaggtgcagctggtggagagcggcggcggcctggtgcagcccggcggcagcctgagactgagctgcgccgccagcggcttcgacttcagcagatactggatgagctgggtgagacaggcccccggcaagggcctggagtggatcggcgagatcaaccccgacagcagcaccatcaactacgcccccagcctgaaggacaagttcatcatcagcagagacaacgccaagaacagcctgtacctgcagatgaacagcctgagagccgaggacaccgccgtgtactactgcgccagacccgacggcaactactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30812 - RNA, 642 nt, synthetic construct
  misc_feature 1..642: note = derived and/or modified sequence opt4 from Elotuzumab_LightChain1
  source 1..642: mol_type = other RNA
gacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30813 - RNA, 1338 nt, synthetic construct
  misc_feature 1..1338: note = derived and/or modified sequence opt4 from Emactuzumab_HeavyChain1
  source 1..1338: mol_type = other RNA
caggtgcagctggtgcagagcggcgccgaggtgaagaagcccggcgccagcgtgaaggtgagctgcaaggccagcggctacaccttcaccagctacgacatcagctgggtgagacaggcccccggccagggcctggagtggatgggcgtgatctggaccgacggcggcaccaactacgcccagaagctgcagggcagagtgaccatgaccaccgacaccagcaccagcaccgcctacatggagctgagaagcctgagaagcgacgacaccgccgtgtactactgcgccagagaccagagactgtacttcgacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30814 - RNA, 639 nt, synthetic construct
  misc_feature 1..639: note = derived and/or modified sequence opt4 from Emactuzumab_LightChain1
  source 1..639: mol_type = other RNA
gacatccagatgacccagagccccagcagcctgagcgccagcgtgggcgacagagtgaccatcacctgcagagccagcgaggacgtgaacacctacgtgagctggtaccagcagaagcccggcaaggcccccaagctgctgatctacgccgccagcaacagatacaccggcgtgcccagcagattcagcggcagcggcagcggcaccgacttcaccctgaccatcagcagcctgcagcccgaggacttcgccacctactactgccagcagagcttcagctaccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30815 - RNA, 1323 nt, synthetic construct
  misc_feature 1..1323: note = derived and/or modified sequence opt4 from Emibetuzumab_HeavyChain1
  source 1..1323: mol_type = other RNA
caggtgcagctggtgcagagcggcgccgaggtgaagaagcccggcgccagcgtgaaggtgagctgcaaggccagcggctacaccttcaccgactactacatgcactgggtgagacaggcccccggccagggcctggagtggatgggcagagtgaaccccaacagaagaggcaccacctacaaccagaagttcgagggcagagtgaccatgaccaccgacaccagcaccagcaccgcctacatggagctgagaagcctgagaagcgacgacaccgccgtgtactactgcgccagagccaactggctggactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgaggccgccggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 30816 - RNA, 645 nt, synthetic construct
  misc_feature 1..645: note = derived and/or modified sequence opt4 from Emibetuzumab_LightChain1
  source 1..645: mol_type = other RNA
gacatccagatgacccagagccccagcagcctgagcgccagcgtgggcgacagagtgaccatcacctgcagcgtgagcagcagcgtgagcagcatctacctgcactggtaccagcagaagcccggcaaggcccccaagctgctgatctacagcaccagcaacctggccagcggcgtgcccagcagattcagcggcagcggcagcggcaccgacttcaccctgaccatcagcagcctgcagcccgaggacttcgccacctactactgccaggtgtacagcggctaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30817 - RNA, 1344 nt, synthetic construct
  misc_feature 1..1344: note = derived and/or modified sequence opt4 from Emicizumab_HeavyChain1
  source 1..1344: mol_type = other RNA
caggtgcagctggtggagagcggcggcggcctggtgcagcccggcggcagcctgagactgagctgcgccgccagcggcttcaccttcagctactacgacatccagtgggtgagacaggcccccggcaagggcctggagtgggtgagcagcatcagccccagcggccagagcacctactacagaagagaggtgaagggcagattcaccatcagcagagacaacagcaagaacaccctgtacctgcagatgaacagcctgagagccgaggacaccgccgtgtactactgcgccagaagaaccggcagagagtacggcggcggctggtacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccagaaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcaggagggcaacgtgttcagctgcagcgtgatgcacgaggccctgcacaacagatacacccagaagagcctgagcctgagcccc

SEQ ID NO: 30818 - RNA, 1332 nt, synthetic construct
  misc_feature 1..1332: note = derived and/or modified sequence opt4 from Emicizumab_HeavyChain2
  source 1..1332: mol_type = other RNA
caggtgcagctggtgcagagcggcagcgagctgaagaagcccggcgccagcgtgaaggtgagctgcaaggccagcggctacaccttcaccgacaacaacatggactgggtgagacaggcccccggccagggcctggagtggatgggcgacatcaacaccagaagcggcggcagcatctacaacgaggagttccaggacagagtgatcatgaccgtggacaagagcaccgacaccgcctacatggagctgagcagcctgagaagcgaggacaccgccacctaccactgcgccagaagaaagagctacggctactacctggacgagtggggcgagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcaggagggcaacgtgttcagctgcagcgtgatgcacgaggccctgcacaaccactacacccaggagagcctgagcctgagcccc

SEQ ID NO: 30819 - RNA, 642 nt, synthetic construct
  misc_feature 1..642: note = derived and/or modified sequence opt4 from Emicizumab_LightChain1
  source 1..642: mol_type = other RNA
gacatccagatgacccagagccccagcagcctgagcgccagcgtgggcgacagagtgaccatcacctgcaaggccagcagaaacatcgagagacagctggcctggtaccagcagaagcccggccaggcccccgagctgctgatctaccaggccagcagaaaggagagcggcgtgcccgacagattcagcggcagcagatacggcaccgacttcaccctgaccatcagcagcctgcagcccgaggacatcgccacctactactgccagcagtacagcgacccccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30820 - RNA, 1347 nt, synthetic construct
  misc_feature 1..1347: note = derived and/or modified sequence opt4 from Enavatuzumab_HeavyChain1
  source 1..1347: mol_type = other RNA
gaggtgcagctggtggagagcggcggcggcctggtgcagcccggcggcagcctgagactgagctgcgccgccagcggcttcaccttcagcagctactggatgagctgggtgagacaggcccccggcaagggcctggagtgggtggccgagatcagactgaagagcgacaactacgccacccactacgccgagagcgtgaagggcagattcaccatcagcagagacgacagcaagaacagcctgtacctgcagatgaacagcctgagagccgaggacaccgccgtgtactactgcaccggctactacgccgacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30821 - RNA, 654 nt, synthetic construct
  misc_feature 1..654: note = derived and/or modified sequence opt4 from Enavatuzumab_LightChain1
  source 1..654: mol_type = other RNA
gacatccagatgacccagagccccagcagcctgagcgccagcgtgggcgacagagtgaccatcacctgcagagccagccagagcgtgagcaccagcagctacagctacatgcactggtaccagcagaagcccggcaaggcccccaagctgctgatcaagtacgccagcaacctggagagcggcgtgcccagcagattcagcggcagcggcagcggcaccgacttcaccctgaccatcagcagcctgcagcccgaggacttcgccacctactactgccagcacagctgggagatcccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30822 - RNA, 1341 nt, synthetic construct
  misc_feature 1..1341: note = derived and/or modified sequence opt4 from Enfortumab_HeavyChain
  source 1..1341: mol_type = other RNA
gaggtgcagctggtggagagcggcggcggcctggtgcagcccggcggcagcctgagactgagctgcgccgccagcggcttcaccttcagcagctacaacatgaactgggtgagacaggcccccggcaagggcctggagtgggtgagctacatcagcagcagcagcagcaccatctactacgccgacagcgtgaagggcagattcaccatcagcagagacaacgccaagaacagcctgagcctgcagatgaacagcctgagagacgaggacaccgccgtgtactactgcgccagagcctactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30823 - RNA, 642 nt, synthetic construct
  misc_feature 1..642: note = derived and/or modified sequence opt4 from Enfortumab_LightChain
  source 1..642: mol_type = other RNA
gacatccagatgacccagagccccagcagcgtgagcgccagcgtgggcgacagagtgaccatcacctgcagagccagccagggcatcagcggctggctggcctggtaccagcagaagcccggcaaggcccccaagttcctgatctacgccgccagcaccctgcagagcggcgtgcccagcagattcagcggcagcggcagcggcaccgacttcaccctgaccatcagcagcctgcagcccgaggacttcgccacctactactgccagcaggccaacagcttcccccccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30824 - RNA, 1341 nt, synthetic construct; identical to SEQ ID NO: 30822
  misc_feature 1..1341: note = derived and/or modified sequence opt4 from Enfortumab_vedotin_HeavyChain1
  source 1..1341: mol_type = other RNA

SEQ ID NO: 30825 - RNA, 642 nt, synthetic construct; identical to SEQ ID NO: 30823
  misc_feature 1..642: note = derived and/or modified sequence opt4 from Enfortumab_vedotin_LightChain1
  source 1..642: mol_type = other RNA

SEQ ID NO: 30826 - RNA, 1356 nt, synthetic construct
  misc_feature 1..1356: note = derived and/or modified sequence opt4 from Enoblituzumab_HeavyChain
  source 1..1356: mol_type = other RNA
gaggtgcagctggtggagagcggcggcggcctggtgcagcccggcggcagcctgagactgagctgcgccgccagcggcttcaccttcagcagcttcggcatgcactgggtgagacaggcccccggcaagggcctggagtgggtggcctacatcagcagcgacagcagcgccatctactacgccgacaccgtgaagggcagattcaccatcagcagagacaacgccaagaacagcctgtacctgcagatgaacagcctgagagacgaggacaccgccgtgtactactgcggcagaggcagagagaacatctactacggcagcagactggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctggtgggcggccccagcgtgttcctgctgccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagccccccgaggagcagtacaacagcaccctgagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccacccccctggtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30827 - RNA, 642 nt, synthetic construct
  misc_feature 1..642: note = derived and/or modified sequence opt4 from Enoblituzumab_LightChain
  source 1..642: mol_type = other RNA
gacatccagctgacccagagccccagcttcctgagcgccagcgtgggcgacagagtgaccatcacctgcaaggccagccagaacgtggacaccaacgtggcctggtaccagcagaagcccggcaaggcccccaaggccctgatctacagcgccagctacagatacagcggcgtgcccagcagattcagcggcagcggcagcggcaccgacttcaccctgaccatcagcagcctgcagcccgaggacttcgccacctactactgccagcagtacaacaactaccccttcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30828 - RNA, 1356 nt, synthetic construct
  misc_feature 1..1356: note = derived and/or modified sequence opt4 from Enokizumab_HeavyChain1
  source 1..1356: mol_type = other RNA
caggtgcagctggtgcagagcggcgccgaggtgaagaagcccggcagcagcgtgaaggtgagctgcaaggccagcggcggcaccttcagctactactggatcgagtgggtgagacaggcccccggccagggcctggagtggatgggcgagatcctgcccggcagcggcaccaccaaccccaacgagaagttcaagggcagagtgaccatcaccgccgacgagagcaccagcaccgcctacatggagctgagcagcctgagaagcgaggacaccgccgtgtactactgcgccagagccgactactacggcagcgactacgtgaagttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30829 - RNA, 642 nt, synthetic construct
  misc_feature 1..642: note = derived and/or modified sequence opt4 from Enokizumab_LightChain1
  source 1..642: mol_type = other RNA
gacatccagatgacccagagccccagcagcctgagcgccagcgtgggcgacagagtgaccatcacctgcaaggccagccagcacgtgatcacccacgtgacctggtaccagcagaagcccggcaaggcccccaagctgctgatctacggcaccagctacagctacagcggcgtgcccagcagattcagcggcagcggcagcggcaccgacttcaccctgaccatcagcagcctgcagcccgaggacttcgccacctactactgccagcagttctacgagtaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30830 - RNA, 612 nt, synthetic construct
  misc_feature 1..612: note = derived and/or modified sequence opt4 from Enokizumab_LightChain
  source 1..612: mol_type = other RNA
gacatccagatgacccagagccccagcagcctgagcgccagcgtgggcgacagagtgaccatcacctgcaaggccagccagcacgtgatcacccacgtgacctggtaccagcagaagcccggcaaggcccccaagctgctgatctacggcaccagctacagctacagcggcgtgcccagcagattcagcggcagcggcagcggcaccgacttcaccctgaccatcagcagcctgcagcccgaggacttcgccacctactactgccagcagttctacgagtaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30831 - RNA, 1356 nt, synthetic construct
  misc_feature 1..1356: note = derived and/or modified sequence opt4 from Enoticumab_HeavyChain1
  source 1..1356: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtgagcttcctgtggtacgacggcaccaacaagaactacgtggagagcgtgaagggcagattcaccatcagcagagacaacagcaagaacatgctgtacctggagatgaacagcctgagagccgaggacaccgccgtgtactactgcgccagagaccacgacttcagaagcggctacgagggctggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30832 - RNA, 642 nt, synthetic construct
  misc_feature 1..642: note = derived and/or modified sequence opt4 from Enoticumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcacagaagcaactggccccccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30833 - RNA, 1329 nt, synthetic construct
  misc_feature 1..1329: note = derived and/or modified sequence opt4 from Ensituximab_HeavyChain1
  source 1..1329: mol_type = other RNA
caggtgcagctgaaggagagcggccccgacctggtggcccccagccagagcctgagcatcacctgcaccgtgagcggcttcagcctgagcaagttcggcgtgaactgggtgagacagccccccggcaagggcctggagtggctgggcgtgatctggggcgacggcagcaccagctacaacagcggcctgatcagcagactgagcatcagcaaggagaacagcaagagccaggtgttcctgaagctgaacagcctgcaggccgacgacaccgccacctactactgcgtgaagcccggcggcgactactggggccacggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcccctacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccatgccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30834 - RNA, 639 nt, synthetic construct
  misc_feature 1..639: note = derived and/or modified sequence opt4 from Ensituximab_LightChain1
  source 1..639: mol_type = other RNA
caggtggtgctgacccagagccccgtgatcatgagcgccagccccggcgagaaggtgaccatgacctgcagcgccagcagcagcatcagctacatgtactggtaccagcagaagcccggcaccagccccaagagatggatctacgacaccagcaagctggccagcggcgtgcccgccagattcagcggcagcggcagcggcaccagctacagcctgaccatcagcaacatggaggccggcgacgccgccacctactactgccaccagagagacagctacccctggaccttcggcggcggcaccaacctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30835 - RNA, 768 nt, synthetic construct; identical to SEQ ID NO: 30806
  misc_feature 1..768: note = derived and/or modified sequence opt4 from Ensituximab_SingleChain_variable_fragment
  source 1..768: mol_type = other RNA

SEQ ID NO: 30836 - RNA, 987 nt, synthetic construct
  misc_feature 1..987: note = derived and/or modified sequence opt4 from Entolimod_chain1
  source 1..987: mol_type = other RNA
atgagaggcagccaccaccaccaccaccacggcatggccagcatgaccggcggccagcagatgggcagagacctgtacgacgacgacgacaaggaccccatggcccaggtgatcaacaccaacagcctgagcctgctgacccagaacaacctgaacaagagccagagcagcctgagcagcgccatcgagagactgagcagcggcctgagaatcaacagcgccaaggacgacgccgccggccaggccatcgccaacagattcaccagcaacatcaagggcctgacccaggccagcagaaacgccaacgacggcatcagcatcgcccagaccaccgagggcgccctgaacgagatcaacaacaacctgcagagagtgagagagctgagcgtgcaggccaccaacggcaccaacagcgacagcgacctgaagagcatccaggacgagatccagcagagactggaggagatcgacagagtgagcaaccagacccagttcaacggcgtgaaggtgctgagccaggacaaccagatgaagatccaggtgggcgccaacgacggcgagaccatcaccatcgacctgcagaagatcgacgtgaagagcctgggcctggacggcttcaacgtgaacagccccggcatcagcggcggcggcggcggcatcctggacagcatgggcaccctgatcaacgaggacgccgccgccgccaagaagagcaccgccaaccccctggccagcatcgacagcgccctgagcaaggtggacgccgtgagaagcagcctgggcgccatccagaacagattcgacagcgccatcaccaacctgggcaacaccgtgaccaacctgaacagcgccagaagcagaatcgaggacgccgactacgccaccgaggtgagcaacatgagcaaggcccagatcctgcagcaggccggcaccagcgtgctggcccaggccaaccaggtgccccagaacgtgctgagcctgctgaga

SEQ ID NO: 30837 - RNA, 1338 nt, synthetic construct
  misc_feature 1..1338: note = derived and/or modified sequence opt4 from Epratuzumab_HeavyChain
  source 1..1338: mol_type = other RNA
caggtgcagctggtgcagagcggcgccgaggtgaagaagcccggcagcagcgtgaaggtgagctgcaaggccagcggctacaccttcaccagctactggctgcactgggtgagacaggcccccggccagggcctggagtggatcggctacatcaaccccagaaacgactacaccgagtacaaccagaacttcaaggacaaggccaccatcaccgccgacgagagcaccaacaccgcctacatggagctgagcagcctgagaagcgaggacaccgccttctacttctgcgccagaagagacatcaccaccttctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30838 - RNA, 657 nt, synthetic construct
  misc_feature 1..657: note = derived and/or modified sequence opt4 from Epratuzumab_LightChain
  source 1..657: mol_type = other RNA
gacatccagctgacccagagccccagcagcctgagcgccagcgtgggcgacagagtgaccatgagctgcaagagcagccagagcgtgctgtacagcgccaaccacaagaactacctggcctggtaccagcagaagcccggcaaggcccccaagctgctgatctactgggccagcaccagagagagcggcgtgcccagcagattcagcggcagcggcagcggcaccgacttcaccttcaccatcagcagcctgcagcccgaggacatcgccacctactactgccaccagtacctgagcagctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30839 - RNA, 762 nt, synthetic construct
  misc_feature 1..762: note = derived and/or modified sequence opt4 from Eptacog_beta_HeavyChain1
  source 1..762: mol_type = other RNA
atcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggagaaacctgatcgccgtgctgggcgagcacgacctgagcgagcacgacggcgacgagcagagcagaagagtggcccaggtgatcatccccagcacctacgtgcccggcaccaccaaccacgacatcgccctgctgagactgcaccagcccgtggtgctgaccgaccacgtggtgcccctgtgcctgcccgagagaaccttcagcgagagaaccctggccttcgtgagattcagcctggtgagcggctggggccagctgctggacagaggcgccaccgccctggagctgatggtgctgaacgtgcccagactgatgacccaggactgcctgcagcagagcagaaaggtgggcgacagccccaacatcaccgagtacatgttctgcgccggctacagcgacggcagcaaggacagctgcaagggcgacagcggcggcccccacgccacccactacagaggcacctggtacctgaccggcatcgtgagctggggccagggctgcgccaccgtgggccacttcggcgtgtacaccagagtgagccagtacatcgagtggctgcagaagctgatgagaagcgagcccagacccggcgtgctgctgagagcccccttcccc

SEQ ID NO: 30840 - RNA, 456 nt, synthetic construct
  misc_feature 1..456: note = derived and/or modified sequence opt4 from Eptacog_beta_LightChain1
  source 1..456: mol_type = other RNA
gccaacgccttcctggaggagctgagacccggcagcctggagagagagtgcaaggaggagcagtgcagcttcgaggaggccagagagatcttcaaggacgccgagagaaccaagctgttctggatcagctacagcgacggcgaccagtgcgccagcagcccctgccagaacggcggcagctgcaaggaccagctgcagagctacatctgcttctgcctgcccgccttcgagggcagaaactgcgagacccacaaggacgaccagctgatctgcgtgaacgagaacggcggctgcgagcagtactgcagcgaccacaccggcaccaagagaagctgcagatgccacgagggctacagcctgctggccgacggcgtgagctgcacccccaccgtggagtacccctgcggcaagatccccatcctggagaagagaaacgccagcaagccccagggcaga

SEQ ID NO: 30841 - RNA, 708 nt, synthetic construct
  misc_feature 1..708: note = derived and/or modified sequence opt4 from Erlizuab_HeavyChain1
  source 1..708: mol_type = other RNA
gaggtgcagctggtggagagcggcggcggcctggtgcagcccggcggcagcctgagactgagctgcgccaccagcggctacaccttcaccgagtacacccactggagacaggcccccggcaagggcctggagtgggtggccggcatcaaccccaagaacggcggcaccagccacaaccagagattcgacagattcaccatcagcgtggacaagagcaccagcaccgcctaccagaacagcctgagagccgaggacaccgccgtgtactactgcgccagatggagaggcctgaactacggcttcgacgtgagatacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctg

SEQ ID NO: 30842 - RNA, 639 nt, synthetic construct
  misc_feature 1..639: note = derived and/or modified sequence opt4 from Erlizuab_LightChain1
  source 1..639: mol_type = other RNA
gacatccagacccagagccccagcagcctgagcgccagcgtgggcgacagagtgaccatcacctgcagagccagccaggacatcaacaactacctgaactggtaccagcagaagcccggcaaggcccccaagctgctgatctactacaccagcaccctgcacagcggcgtgcccagcagattcagcggcagcggcagcggcaccgactacaccctgaccatcagcagcctgcagcccgaggacttcgccacctactactgccagcagggcaacaccctgccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30843 - RNA, 1341 nt, synthetic construct
  misc_feature 1..1341: note = derived and/or modified sequence opt4 from Etaracizumab_HeavyChain1
  source 1..1341: mol_type = other RNA
caggtgcagctggtggagagcggcggcggcgtggtgcagcccggcagaagcctgagactgagctgcgccgccagcggcttcaccttcagcagctacgacatgagctgggtgagacaggcccccggcaagggcctggagtgggtggccaaggtgagcagcggcggcggcagcacctactacctggacaccgtgcagggcagattcaccatcagcagagacaacagcaagaacaccctgtacctgcagatgaacagcctgagagccgaggacaccgccgtgtactactgcgccagacacctgcacggcagcttcgccagctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30844 - RNA, 642 nt, synthetic construct
  misc_feature 1..642: note = derived and/or modified sequence opt4 from Etaracizumab_LightChain1
  source 1..642: mol_type = other RNA
gagatcgtgctgacccagagccccgccaccctgagcctgagccccggcgagagagccaccctgagctgccaggccagccagagcatcagcaacttcctgcactggtaccagcagagacccggccaggcccccagactgctgatcagatacagaagccagagcatcagcggcatccccgccagattcagcggcagcggcagcggcaccgacttcaccctgaccatcagcagcctggagcccgaggacttcgccgtgtactactgccagcagagcggcagctggcccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30845 - RNA, 1326 nt, synthetic construct
  misc_feature 1..1326: note = derived and/or modified sequence opt4 from Etrolizuab_HeavyChain1
  source 1..1326: mol_type = other RNA
gaggtgcagctggtggagagcggcggcggcctggtgcagcccggcggcagcctgagactgagctgcgccgccagcggcttcttcatcaccaacaactactggggctgggtgagacaggcccccggcaagggcctggagtgggtgggctacatcagctacagcggcagcaccagctacaaccccagcctgaagagcagattcaccatcagcagagacaccagcaagaacaccttctacctgcagaacagcctgagagccgaggacaccgccgtgtactactgcgccagaaccggcagcagcggctacttcgacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 30846 - RNA, 1326 nt, synthetic construct
  misc_feature 1..1326: note = derived and/or modified sequence opt4 from Etrolizuab_HeavyChain2
  source 1..1326: mol_type = other RNA
gaggtgcagctggtggagagcggcggcggcctggtgcagcccggcggcagcctgagactgagctgcgccgccagcggcttcttcatcaccaacaactactggggctgggtgagacaggcccccggcaagggcctggagtgggtgggctacatcagctacagcggcagcaccagctacaaccccagcaagctgagcagattcaccatcagcagagacaccagcaagaacaccttctacctgcagaacagcctgagagccgaggacaccgccgtgtactactgcgccagaaccggcagcagcggctacttcgacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 30847 - RNA, 639 nt, synthetic construct
  misc_feature 1..639: note = derived and/or modified sequence opt4 from Etrolizuab_LightChain1
  source 1..639: mol_type = other RNA
gacatccagacccagagccccagcagcctgagcgccagcgtgggcgacagagtgaccatcacctgcagagccagcgagagcgtggacgacctgctgcactggtaccagcagaagcccggcaaggcccccaagctgctgatcaagtacgccagccagagcatcagcggcgtgcccagcagattcagcggcagcggcagcggcaccgacttcaccctgaccatcagcagcctgcagcccgaggacttcgccacctactactgccagcagggcaacagcctgcccaacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30848 - RNA, 1338 nt, synthetic construct
  misc_feature 1..1338: note = derived and/or modified sequence opt4 from Etrolizumab_HeavyChain1
  source 1..1338: mol_type = other RNA
gaggtgcagctggtggagagcggcggcggcctggtgcagcccggcggcagcctgagactgagctgcgccgccagcggcttcttcatcaccaacaactactggggctgggtgagacaggcccccggcaagggcctggagtgggtgggctacatcagctacagcggcagcaccagctacaaccccagcctgaagagcagattcaccatcagcagagacaccagcaagaacaccttctacctgcagatgaacagcctgagagccgaggacaccgccgtgtactactgcgccagaaccggcagcagcggctacttcgacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30849 - RNA, 642 nt, synthetic construct
  misc_feature 1..642: note = derived and/or modified sequence opt4 from Etrolizumab_LightChain1
  source 1..642: mol_type = other RNA
gacatccagatgacccagagccccagcagcctgagcgccagcgtgggcgacagagtgaccatcacctgcagagccagcgagagcgtggacgacctgctgcactggtaccagcagaagcccggcaaggcccccaagctgctgatcaagtacgccagccagagcatcagcggcgtgcccagcagattcagcggcagcggcagcggcaccgacttcaccctgaccatcagcagcctgcagcccgaggacttcgccacctactactgccagcagggcaacagcctgcccaacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30850 - RNA, 1359 nt, synthetic construct
  misc_feature 1..1359: note = derived and/or modified sequence opt4 from Evinacumab_HeavyChain1
  source 1..1359: mol_type = other RNA
gaggtgcagctggtggagagcggcggcggcgtgatccagcccggcggcagcctgagactgagctgcgccgccagcggcttcaccttcgacgactacgccatgaactgggtgagacagggccccggcaagggcctggagtgggtgagcgccatcagcggcgacggcggcagcacctactacgccgacagcgtgaagggcagattcaccatcagcagagacaacagcaagaacagcctgtacctgcagatgaacagcctgagagccgaggacaccgccttcttctactgcgccaaggacctgagaaacaccatcttcggcgtggtgatccccgacgccttcgacatctggggccagggcaccatggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30851 - RNA, 642 nt, synthetic construct
  misc_feature 1..642: note = derived and/or modified sequence opt4 from Evinacumab_LightChain1
  source 1..642: mol_type = other RNA
gacatccagatgacccagagccccagcaccctgagcgccagcgtgggcgacagagtgaccatcacctgcagagccagccagagcatcagaagctggctggcctggtaccagcagaagcccggcaaggcccccaagctgctgatctacaaggccagcagcctggagagcggcgtgcccagcagattcagcggcagcggcagcggcaccgagttcaccctgaccatcagcagcctgcagcccgacgacttcgccacctactactgccagcagtacaacagctacagctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30852 - RNA, 1323 nt, synthetic construct
  misc_feature 1..1323: note = derived and/or modified sequence opt4 from Evolocumab_HeavyChain1
  source 1..1323: mol_type = other RNA
gaggtgcagctggtgcagagcggcgccgaggtgaagaagcccggcgccagcgtgaaggtgagctgcaaggccagcggctacaccctgaccagctacggcatcagctgggtgagacaggcccccggccagggcctggagtggatgggctgggtgagcttctacaacggcaacaccaactacgcccagaagctgcagggcagaggcaccatgaccaccgaccccagcaccagcaccgcctacatggagctgagaagcctgagaagcgacgacaccgccgtgtactactgcgccagaggctacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30853 - RNA, 645 nt, synthetic construct
  misc_feature 1..645: note = derived and/or modified sequence opt4 from Evolocumab_LightChain1
  source 1..645: mol_type = other RNA
gagagcgccctgacccagcccgccagcgtgagcggcagccccggccagagcatcaccatcagctgcaccggcaccagcagcgacgtgggcggctacaacagcgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcaacagctacaccagcaccagcatggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30854 - RNA, 1353 nt, synthetic construct
  misc_feature 1..1353: note = derived and/or modified sequence opt4 from Exbivirumab_HeavyChain1
  source 1..1353: mol_type = other RNA
caggtgcagctggtggagagcggcggcggcgtggtgcagcccggcggcagcctgagactgagctgcgcccccagcggcttcgtgttcagaagctacggcatgcactgggtgagacagacccccggcaagggcctggagtgggtgagcctgatctggcacgacggcagcaacagattctacgccgacagcgtgaagggcagattcaccatcagcagagacaacagcaagaacaccctgtacctgcagatgaacagcctgagagccgaggacaccgccatgtacttctgcgccagagagagactgatcgccgcccccgccgccttcgacctgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30855 - RNA, 642 nt, synthetic construct
  misc_feature 1..642: note = derived and/or modified sequence opt4 from Exbivirumab_LightChain1
  source 1..642: mol_type = other RNA
agctacgtgctgacccagccccccagcgtgagcgtggcccccggcaagaccgccagaatcagctgcggcggcaacaacatcggcaccaagaacgtgcactggtaccagcagaagcccggccaggcccccgtgctggtggtgtacgccgacagcgacagacccagcggcatccccgagagattcagcggcagcaacagcggcaacaccgccaccctgaccatcagcagagtggaggccggcgacgaggccgactactactgccaggtgtgggacagcgtgagctaccacgtggtgttcggcggcggcaccaccctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30856 - RNA, 1347 nt, synthetic construct
  misc_feature 1..1347: note = derived and/or modified sequence opt4 from Farletuzumab_HeavyChain1
  source 1..1347: mol_type = other RNA
gaggtgcagctggtggagagcggcggcggcgtggtgcagcccggcagaagcctgagactgagctgcagcgccagcggcttcaccttcagcggctacggcctgagctgggtgagacaggcccccggcaagggcctggagtgggtggccatgatcagcagcggcggcagctacacctactacgccgacagcgtgaagggcagattcgccatcagcagagacaacgccaagaacaccctgttcctgcagatggacagcctgagacccgaggacaccggcgtgtacttctgcgccagacacggcgacgaccccgcctggttcgcctactggggccagggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30857 - RNA, 651 nt, synthetic construct
  misc_feature 1..651: note = derived and/or modified sequence opt4 from Farletuzumab_LightChain1
  source 1..651: mol_type = other RNA
gacatccagctgacccagagccccagcagcctgagcgccagcgtgggcgacagagtgaccatcacctgcagcgtgagcagcagcatcagcagcaacaacctgcactggtaccagcagaagcccggcaaggcccccaagccctggatctacggcaccagcaacctggccagcggcgtgcccagcagattcagcggcagcggcagcggcaccgactacaccttcaccatcagcagcctgcagcccgaggacatcgccacctactactgccagcagtggagcagctacccctacatgtacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30858 - RNA, 1338 nt, synthetic construct
  misc_feature 1..1338: note = derived and/or modified sequence opt4 from Fasinumab_HeavyChain1
  source 1..1338: mol_type = other RNA
caggtgcagctggtgcagagcggcgccgaggtgaagaagcccggcgccagcgtgaaggtgagctgcaaggtgagcggcttcaccctgaccgagctgagcatccactgggtgagacaggcccccggcaagggcctggagtggatgggcggcttcgaccccgaggacggcgagaccatctacgcccagaagttccagggcagagtgaccatgaccgaggacaccagcaccgacaccgcctacatggagctgaccagcctgagaagcgaggacaccgccgtgtactactgcagcaccatcttcggcgtggtgaccaacttcgacaactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30859 - RNA, 642 nt, synthetic construct
  misc_feature 1..642: note = derived and/or modified sequence opt4 from Fasinumab_LightChain1
  source 1..642: mol_type = other RNA
gacatccagatgacccagagccccagcagcctgagcgccagcgccggcgacagagtgaccatcacctgcagagccagccaggccatcagaaacgacctgggctggtaccagcagaagcccggcaaggcccccaagagactgatctacgccgccttcaacctgcagagcggcgtgcccagcagattcagcggcagcggcagcggcaccgagttcaccctgaccatcagcagcctgcagcccgaggacctggccagctactactgccagcagtacaacagatacccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30860 - RNA, 1350 nt, synthetic construct
  misc_feature 1..1350: note = derived and/or modified sequence opt4 from Fezakinumab_HeavyChain1
  source 1..1350: mol_type = other RNA
caggtgcagctggtgcagagcggcgccgaggtgaagaagcccggcgccagcgtgaaggtgagctgcaaggccagcggctacaccttcaccaactactacatgcactgggtgagacaggcccccggccagggcctggagtgggtgggctggatcaacccctacaccggcagcgccttctacgcccagaagttcagaggcagagtgaccatgaccagagacaccagcatcagcaccgcctacatggagctgagcagactgagaagcgacgacaccgccgtgtactactgcgccagagagcccgagaagttcgacagcgacgacagcgacgtgtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30861 - RNA, 651 nt, synthetic construct
  misc_feature 1..651: note = derived and/or modified sequence opt4 from Fezakinumab_LightChain1
  source 1..651: mol_type = other RNA
caggccgtgctgacccagccccccagcgtgagcggcgcccccggccagagagtgaccatcagctgcaccggcagcagcagcaacatcggcgccggctacggcgtgcactggtaccagcagctgcccggcaccgcccccaagctgctgatctacggcgacagcaacagacccagcggcgtgcccgacagattcagcggcagcaagagcggcaccagcgccagcctggccatcaccggcctgcaggccgaggacgaggccgactactactgccagagctacgacaacagcctgagcggctacgtgttcggcggcggcacccagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30862 - RNA, 1347 nt, synthetic construct
  misc_feature 1..1347: note = derived and/or modified sequence opt4 from FG-3019_HeavyChain1
  source 1..1347: mol_type = other RNA
gagggccagctggtgcagagcggcggcggcctggtgcaccccggcggcagcctgagactgagctgcgccggcagcggcttcaccttcagcagctacggcatgcactgggtgagacaggcccccggcaagggcctggagtgggtgagcggcatcggcaccggcggcggcacctacagcaccgacagcgtgaagggcagattcaccatcagcagagacaacgccaagaacagcctgtacctgcagatgaacagcctgagagccgaggacatggccgtgtactactgcgccagaggcgactactacggcagcggcagcttcttcgactgctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30863 - RNA, 642 nt, synthetic construct
  misc_feature 1..642: note = derived and/or modified sequence opt4 from FG-3019_LightChain1
  source 1..642: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30864 - RNA, 1344 nt, synthetic construct
  misc_feature 1..1344: note = derived and/or modified sequence opt4 from Fibatuzumab_HeavyChain1
  source 1..1344: mol_type = other RNA
caggtgcagctggtgcagagcggcgccgaggtgaagaagcccggcgccagcgtgaaggtgagctgcaaggccagcggctacaccttcaccggctactggatgaactgggtgagacaggcccccggccagggcctggagtggatgggcgacatctaccccggcagcggcaacaccaactacgacgagaagttccagggcagagtgaccatgaccagagacaccagcatcagcaccgcctacatggagctgagcagactgagaagcgacgacaccgccgtgtactactgcgccagaggcggctactacgaggacttcgacagctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30865 - RNA, 642 nt, synthetic construct
  misc_feature 1..642: note = derived and/or modified sequence opt4 from Fibatuzumab_LightChain1
  source 1..642: mol_type = other RNA
gacatccagatgacccagagccccagcttcctgagcgccagcgtgggcgacagagtgaccatcacctgcagagccagccagggcatcatcagctacctggcctggtaccagcagaagcccgagaaggcccccaagagactgatctacgccgccagcagcctgcagagcggcgtgcccagcagattcagcggcagcggcagcggcaccgagttcaccctgaccatcagcagcctgcagcccgaggacttcgccacctactactgcggccagtacgccaactacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30866 - RNA, 1344 nt, synthetic construct
  misc_feature 1..1344: note = derived and/or modified sequence opt4 from Ficlatuzumab_HeavyChain1
  source 1..1344: mol_type = other RNA
caggtgcagctggtgcagcccggcgccgaggtgaagaagcccggcaccagcgtgaagctgagctgcaaggccagcggctacaccttcaccacctactggatgcactgggtgagacaggcccccggccagggcctggagtggatcggcgagatcaaccccaccaacggccacaccaactacaaccagaagttccagggcagagccaccctgaccgtggacaagagcaccagcaccgcctacatggagctgagcagcctgagaagcgaggacaccgccgtgtactactgcgccagaaactacgtgggcagcatcttcgactactggggccagggcaccctgctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30867 - RNA, 1341 nt, synthetic construct
  misc_feature 1..1341: note = derived and/or modified sequence opt4 from Ficlatuzumab_HeavyChain
  source 1..1341: mol_type = other RNA
gtgcagctggtgcagcccggcgccgaggtgaagaagcccggcaccagcgtgaagctgagctgcaaggccagcggctacaccttcaccacctactggatgcactgggtgagacaggcccccggccagggcctggagtggatcggcgagatcaaccccaccaacggccacaccaactacaaccagaagttccagggcagagccaccctgaccgtggacaagagcaccagcaccgcctacatggagctgagcagcctgagaagcgaggacaccgccgtgtactactgcgccagaaactacgtgggcagcatcttcgactactggggccagggcaccctgctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30868 - RNA, 642 nt, synthetic construct
  misc_feature 1..642: note = derived and/or modified sequence opt4 from Ficlatuzumab_LightChain1
  source 1..642: mol_type = other RNA
gacatcgtgatgacccagagccccgacagcctggccatgagcctgggcgagagagtgaccctgaactgcaaggccagcgagaacgtggtgagctacgtgagctggtaccagcagaagcccggccagagccccaagctgctgatctacggcgccagcaacagagagagcggcgtgcccgacagattcagcggcagcggcagcgccaccgacttcaccctgaccatcagcagcgtgcaggccgaggacgtggccgactaccactgcggccagagctacaactacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30869 - RNA, 1350 nt, synthetic construct
  misc_feature 1..1350: note = derived and/or modified sequence opt4 from Figitumumab_HeavyChain1
  source 1..1350: mol_type = other RNA
gaggtgcagctgctggagagcggcggcggcctggtgcagcccggcggcagcctgagactgagctgcaccgccagcggcttcaccttcagcagctacgccatgaactgggtgagacaggcccccggcaagggcctggagtgggtgagcgccatcagcggcagcggcggcaccaccttctacgccgacagcgtgaagggcagattcaccatcagcagagacaacagcagaaccaccctgtacctgcagatgaacagcctgagagccgaggacaccgccgtgtactactgcgccaaggacctgggctggagcgacagctactactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30870 - RNA, 642 nt, synthetic construct
  misc_feature 1..642: note = derived and/or modified sequence opt4 from Figitumumab_LightChain1
  source 1..642: mol_type = other RNA
gacatccagatgacccagttccccagcagcctgagcgccagcgtgggcgacagagtgaccatcacctgcagagccagccagggcatcagaaacgacctgggctggtaccagcagaagcccggcaaggcccccaagagactgatctacgccgccagcagactgcacagaggcgtgcccagcagattcagcggcagcggcagcggcaccgagttcaccctgaccatcagcagcctgcagcccgaggacttcgccacctactactgcctgcagcacaacagctacccctgcagcttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30871 - RNA, 1359 nt, synthetic construct
  misc_feature 1..1359: note = derived and/or modified sequence opt4 from Firivumab_HeavyChain1
  source 1..1359: mol_type = other RNA
caggtgcagctggtgcagagcggcgccgaggtgaagatgcccggcagcagcgtgaaggtgagctgcaagaccagcggcgtgttcttcagcagccacgccatcagctgggtgagacaggcccccggccagggcctggagtggatgggcggcatcagccccatgttcggcaccacccactacgcccagaagttccagggcagagtgaccatcaccgccgaccagagcaccaccaccgcctacatggagctgaccagcctgaccagcgaggacaccgccgtgtactactgcgccagagacggcgccggcagctactaccccctgaactggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 30872 - RNA, 642 nt, synthetic construct
  misc_feature 1..642: note = derived and/or modified sequence opt4 from Firivumab_LightChain1
  source 1..642: mol_type = other RNA
gagatcgtgctgacccagagccccgccaccctgagcctgagccccggcgagagagccaccctgagctgcagagccagcgagaacatctggaacaacctggcctggtaccagcagaagcccggccaggcccccagactgctgatcagcggcgccagcaccggcgccaccggcgtgcccagcagattcagaggcagcggcagcagaaccgagttcaccctgaccatcagcagcctgcagagcgaggacttcgccatctacttctgccagcagtacaacagctggcccagaaccttcggccccggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30873 - RNA, 1347 nt, synthetic construct
  misc_feature 1..1347: note = derived and/or modified sequence opt4 from Flanvotumab_HeavyChain1
  source 1..1347: mol_type = other RNA
caggtgcagctggtgcagagcggcagcgagctgaagaagcccggcgccagcgtgaagatcagctgcaaggccagcggctacaccttcaccagctacgccatgaactgggtgagacaggcccccggccagggcctggagagcatgggctggatcaacaccaacaccggcaaccccacctacgcccagggcttcaccggcagattcgtgttcagcatggacaccagcgtgagcaccgcctacctgcagatcagcagcctgaaggccgaggacaccgccatctactactgcgcccccagatacagcagcagctggtacctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30874 - RNA, 645 nt, synthetic construct
  misc_feature 1..645: note = derived and/or modified sequence opt4 from Flanvotumab_LightChain1
  source 1..645: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggctgatgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30875 - RNA, 1362 nt, synthetic construct
  misc_feature 1..1362: note = derived and/or modified sequence opt4 from Fletikumab_HeavyChain1
  source 1..1362: mol_type = other RNA
caggtgcagctggtgcagagcggcgccgaggtgaagagacccggcgccagcgtgaaggtgagctgcaaggccagcggctacaccttcaccaacgacatcatccactgggtgagacaggcccccggccagagactggagtggatgggctggatcaacgccggctacggcaacacccagtacagccagaacttccaggacagagtgagcatcaccagagacaccagcgccagcaccgcctacatggagctgatcagcctgagaagcgaggacaccgccgtgtactactgcgccagagagcccctgtggttcggcgagagcagcccccacgactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30876 - RNA, 642 nt, synthetic construct
  misc_feature 1..642: note = derived and/or modified sequence opt4 from Fletikumab_LightChain1
  source 1..642: mol_type = other RNA
gccatccagctgacccagagccccagcagcctgagcgccagcgtgggcgacagagtgaccatcacctgcagagccagccagggcatcagcagcgccctggcctggtaccagcagaagcccggcaaggcccccaagctgctgatctacgacgccagcagcctggagagcggcgtgcccagcagattcagcggcagcggcagcggcaccgacttcaccctgaccatcagcagcctgcagcccgaggacttcgccacctactactgccagcagttcaacagctaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30877 - RNA, 1341 nt, synthetic construct
  misc_feature 1..1341: note = derived and/or modified sequence opt4 from Fontolizumab_HeavyChain1
  source 1..1341: mol_type = other RNA
caggtgcagctggtgcagagcggcgccgagctgaagaagcccggcagcagcgtgaaggtgagctgcaaggccagcggctacatcttcaccagcagctggatcaactgggtgaagcaggcccccggccagggcctggagtggatcggcagaatcgaccccagcgacggcgaggtgcactacaaccaggacttcaaggacaaggccaccctgaccgtggacaagagcaccaacaccgcctacatggagctgagcagcctgagaagcgaggacaccgccgtgtactactgcgccagaggcttcctgccctggttcgccgactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30878 - RNA, 642 nt, synthetic construct
  misc_feature 1..642: note = derived and/or modified sequence opt4 from Fontolizumab_LightChain1
  source 1..642: mol_type = other RNA
gacatccagatgacccagagccccagcaccctgagcgccagcgtgggcgacagagtgaccatcacctgcaaggccagcgagaacgtggacacctacgtgagctggtaccagcagaagcccggcaaggcccccaagctgctgatctacggcgccagcaacagatacaccggcgtgcccagcagattcagcggcagcggcagcggcaccgacttcaccctgaccatcagcagcctgcagcccgacgacttcgccacctactactgcggccagagctacaactaccccttcaccttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30879 - RNA, 1344 nt, synthetic construct
  misc_feature 1..1344: note = derived and/or modified sequence opt4 from Foralumab_HeavyChain1
  source 1..1344: mol_type = other RNA
caggtgcagctggtggagagcggcggcggcgtggtgcagcccggcagaagcctgagactgagctgcgccgccagcggcttcaagttcagcggctacggcatgcactgggtgagacaggcccccggcaagggcctggagtgggtggccgtgatctggtacgacggcagcaagaagtactacgtggacagcgtgaagggcagattcaccatcagcagagacaacagcaagaacaccctgtacctgcagatgaacagcctgagagccgaggacaccgccgtgtactactgcgccagacagatgggctactggcacttcgacctgtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgaggccgagggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30880 - RNA, 645 nt, synthetic construct
  misc_feature 1..645: note = derived and/or modified sequence opt4 from Foralumab_LightChain1
  source 1..645: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30881 - RNA, 1344 nt, synthetic construct
  misc_feature 1..1344: note = derived and/or modified sequence opt4 from Foravirumab_HeavyChain1
  source 1..1344: mol_type = other RNA
caggtgcagctggtggagagcggcggcggcgccgtgcagcccggcagaagcctgagactgagctgcgccgccagcggcttcaccttcagcagctacggcatgcactgggtgagacaggcccccggcaagggcctggagtgggtggccgtgatcctgtacgacggcagcgacaagttctacgccgacagcgtgaagggcagattcaccatcagcagagacaacagcaagaacaccctgtacctgcagatgaacagcctgagagccgaggacaccgccgtgtactactgcgccaaggtggccgtggccggcacccacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30882 - RNA, 1344 nt, synthetic construct
  misc_feature 1..1344: note = derived and/or modified sequence opt4 from Foravirumab_HeavyChain
  source 1..1344: mol_type = other RNA
gaggtgcagctggtggagagcggcggcggcgccgtgcagcccggcagaagcctgagactgagctgcgccgccagcggcttcaccttcagcagctacggcatgcactgggtgagacaggcccccggcaagggcctggagtgggtggccgtgatcctgtacgacggcagcgacaagttctacgccgacagcgtgaagggcagattcaccatcagcagagacaacagcaagaacaccctgtacctgcagatgaacagcctgagagccgaggacaccgccgtgtactactgcgccaaggtggccgtggccggcacccacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30883 - RNA, 642 nt, synthetic construct
  misc_feature 1..642: note = derived and/or modified sequence opt4 from Foravirumab_LightChain1
  source 1..642: mol_type = other RNA
gacatccagatgacccagagccccagcagcctgagcgccagcgtgggcgacagagtgaccatcacctgcagagccagccagggcatcagaaacgacctgggctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagctgaacagctacccccccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30884 - RNA, 1341 nt, synthetic construct
  misc_feature 1..1341: note = derived and/or modified sequence opt4 from Fresolimumab_HeavyChain1
  source 1..1341: mol_type = other RNA
caggtgcagctggtgcagagcggcgccgaggtgaagaagcccggcagcagcgtgaaggtgagctgcaaggccagcggctacaccttcagcagcaacgtgatcagctgggtgagacaggcccccggccagggcctggagtggatgggcggcgtgatccccatcgtggacatcgccaactacgcccagagattcaagggcagagtgaccatcaccgccgacgagagcaccagcaccacctacatggagctgagcagcctgagaagcgaggacaccgccgtgtactactgcgccagcaccctgggcctggtgctggacgccatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 30885 - RNA, 645 nt, synthetic construct
  misc_feature 1..645: note = derived and/or modified sequence opt4 from Fresolimumab_LightChain1
  source 1..645: mol_type = other RNA
gagaccgtgctgacccagagccccggcaccctgagcctgagccccggcgagagagccaccctgagctgcagagccagccagagcctgggcagcagctacctggcctggtaccagcagaagcccggccaggcccccagactgctgatctacggcgccagcagcagagcccccggcatccccgacagattcagcggcagcggcagcggcaccgacttcaccctgaccatcagcagactggagcccgaggacttcgccgtgtactactgccagcagtacgccgacagccccatcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30886 - RNA, 1347 nt, synthetic construct
  misc_feature 1..1347: note = derived and/or modified sequence opt4 from Fulranumab_HeavyChain1
  source 1..1347: mol_type = other RNA
gaggtgcagctggtggagagcggcggcggcctggtgcagcccggcggcagcctgagactgagctgcgccgccagcggcttcaccctgagaagctacagcatgaactgggtgagacaggcccccggcaagggcctggagtgggtgagctacatcagcagaagcagccacaccatcttctacgccgacagcgtgaagggcagattcaccatcagcagagacaacgccaagaacagcctgtacctgcagatggacagcctgagagacgaggacaccgccatgtactactgcgccagagtgtacagcagcggctggcacgtgagcgactacttcgactactggggccagggcatcctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30887 - RNA, 642 nt, synthetic construct; identical to SEQ ID NO: 30876
  misc_feature 1..642: note = derived and/or modified sequence opt4 from Fulranumab_LightChain1
  source 1..642: mol_type = other RNA

SEQ ID NO: 30888 - RNA, 1356 nt, synthetic construct
  misc_feature 1..1356: note = derived and/or modified sequence opt4 from Futuximab_HeavyChain1
  source 1..1356: mol_type = other RNA
gaggtgcagctgcagcagcccggcagcgagctggtgagacccggcgccagcgtgaagctgagctgcaaggccagcggctacaccttcaccagctactggatgcactgggtgaagcagagacccggccagggcctggagtggatcggcaacatctaccccggcagcagaagcaccaactacgacgagaagttcaagagcaaggccaccctgaccgtggacaccagcagcagcaccgcctacatgcagctgagcagcctgaccagcgaggacagcgccgtgtactactgcaccagaaacggcgactactacgtgagcagcggcgacgccatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30889 - RNA, 642 nt, synthetic construct
  misc_feature 1..642: note = derived and/or modified sequence opt4 from Futuximab_LightChain1
  source 1..642: mol_type = other RNA
gacatccagatgacccagaccaccagcagcctgagcgccagcctgggcgacagagtgaccatcagctgcagaaccagccaggacatcggcaactacctgaactggtaccagcagaagcccgacggcaccgtgaagctgctgatctactacaccagcagactgcacagcggcgtgcccagcagattcagcggcagcggcagcggcaccgacttcagcctgaccatcaacaacgtggagcaggaggacgtggccacctacttctgccagcactacaacaccgtgccccccaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30890 - RNA, 1335 nt, synthetic construct
  misc_feature 1..1335: note = derived and/or modified sequence opt4 from Galcanezumab_HeavyChain1
  source 1..1335: mol_type = other RNA
caggtgcagctggtgcagagcggcgccgaggtgaagaagcccggcagcagcgtgaaggtgagctgcaaggccagcggctacaccttcggcaactactggatgcagtgggtgagacaggcccccggccagggcctggagtggatgggcgccatctacgagggcaccggcaagaccgtgtacatccagaagttcgccgacagagtgaccatcaccgccgacaagagcaccagcaccgcctacatggagctgagcagcctgagaagcgaggacaccgccgtgtactactgcgccagactgagcgactacgtgagcggcttcggctactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgaggccgccggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 30891 - RNA, 642 nt, synthetic construct
  misc_feature 1..642: note = derived and/or modified sequence opt4 from Galcanezumab_LightChain1
  source 1..642: mol_type = other RNA
gacatccagatgacccagagccccagcagcctgagcgccagcgtgggcgacagagtgaccatcacctgcagagccagcaaggacatcagcaagtacctgaactggtaccagcagaagcccggcaaggcccccaagctgctgatctactacaccagcggctaccacagcggcgtgcccagcagattcagcggcagcggcagcggcaccgacttcaccctgaccatcagcagcctgcagcccgaggacttcgccacctactactgccagcagggcgacgccctgccccccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30892 - RNA, 1371 nt, synthetic construct
  misc_feature 1..1371: note = derived and/or modified sequence opt4 from Galiximab_HeavyChain1
  source 1..1371: mol_type = other RNA
caggtgcagctgcaggagagcggccccggcctggtgaagcccagcgagaccctgagcctgacctgcgccgtgagcggcggcagcatcagcggcggctacggctggggctggatcagacagccccccggcaagggcctggagtggatcggcagcttctacagcagcagcggcaacacctactacaaccccagcctgaagagccaggtgaccatcagcaccgacaccagcaagaaccagttcagcctgaagctgaacagcatgaccgccgccgacaccgccgtgtactactgcgtgagagacagactgttcagcgtggtgggcatggtgtacaacaactggttcgacgtgtggggccccggcgtgctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30893 - RNA, 648 nt, synthetic construct
  misc_feature 1..648: note = derived and/or modified sequence opt4 from Galiximab_LightChain1
  source 1..648: mol_type = other RNA
gagagcgccctgacccagccccccagcgtgagcggcgcccccggccagaaggtgaccatcagctgcaccggcagcaccagcaacatcggcggctacgacctgcactggtaccagcagctgcccggcaccgcccccaagctgctgatctacgacatcaacaagagacccagcggcatcagcgacagattcagcggcagcaagagcggcaccgccgccagcctggccatcaccggcctgcagaccgaggacgaggccgactactactgccagagctacgacagcagcctgaacgcccaggtgttcggcggcggcaccagactgaccgtgctgggccagcccaaggccgcccccaccgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30894 - RNA, 1347 nt, synthetic construct
  misc_feature 1..1347: note = derived and/or modified sequence opt4 from Ganitumab_HeavyChain1
  source 1..1347: mol_type = other RNA
caggtgcagctgcaggagagcggccccggcctggtgaagcccagcggcaccctgagcctgacctgcgccgtgagcggcggcagcatcagcagcagcaactggtggagctgggtgagacagccccccggcaagggcctggagtggatcggcgagatctaccacagcggcagcaccaactacaaccccagcctgaagagcagagtgaccatcagcgtggacaagagcaagaaccagttcagcctgaagctgagcagcgtgaccgccgccgacaccgccgtgtactactgcgccagatggaccggcagaaccgacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30895 - RNA, 657 nt, synthetic construct
  misc_feature 1..657: note = derived and/or modified sequence opt4 from Ganitumab_LightChain1
  source 1..657: mol_type = other RNA
gacgtggtgatgacccagagccccctgagcctgcccgtgacccccggcgagcccgccagcatcagctgcagaagcagccagagcctgctgcacagcaacggctacaactacctggactggtacctgcagaagcccggccagagcccccagctgctgatctacctgggcagcaacagagccagcggcgtgcccgacagattcagcggcagcggcagcggcaccgacttcaccctgaagatcagcagagtggaggccgaggacgtgggcgtgtactactgcatgcagggcacccactggcccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30896 - RNA, 1368 nt, synthetic construct
  misc_feature 1..1368: note = derived and/or modified sequence opt4 from Gantenerumab_HeavyChain1
  source 1..1368: mol_type = other RNA
caggtggagctggtggagagcggcggcggcctggtgcagcccggcggcagcctgagactgagctgcgccgccagcggcttcaccttcagcagctacgccatgagctgggtgagacaggcccccggcaagggcctggagtgggtgagcgccatcaacgccagcggcaccagaacctactacgccgacagcgtgaagggcagattcaccatcagcagagacaacagcaagaacaccctgtacctgcagatgaacagcctgagagccgaggacaccgccgtgtactactgcgccagaggcaagggcaacacccacaagccctacggctacgtgagatacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30897 - RNA, 645 nt, synthetic construct
  misc_feature 1..645: note = derived and/or modified sequence opt4 from Gantenerumab_LightChain1
  source 1..645: mol_type = other RNA
gacatcgtgctgacccagagccccgccaccctgagcctgagccccggcgagagagccaccctgagctgcagagccagccagagcgtgagcagcagctacctggcctggtaccagcagaagcccggccaggcccccagactgctgatctacggcgccagcagcagagccaccggcgtgcccgccagattcagcggcagcggcagcggcaccgacttcaccctgaccatcagcagcctggagcccgaggacttcgccacctactactgcctgcagatctacaacatgcccatcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30898 - RNA, 348 nt, synthetic construct
  misc_feature 1..348: note = derived and/or modified sequence opt4 from Gemtuzumab_HeavyChain1
  source 1..348: mol_type = other RNA
caggtgcagctgcagcagagcggcgccgagctggccaagcccggcgccagcgtgaagatgagctgcaaggccagcggctacaccttcaccagctacagaatgcactgggtgaagcagagacccggccagggcctggagtggatcggctacatcaaccccagcaccggctacaccgagtacaaccagaagttcaaggacaaggccaccctgaccgccgacaagagcagcagcaccgcctacatgcagctgagcagcctgaccttcgaggacagcgccgtgtactactgcgccagaggcggcggcgtgttcgactactggggccagggcaccaccctgaccgtgagcagc

SEQ ID NO: 30899 - RNA, 351 nt, synthetic construct
  misc_feature 1..351: note = derived and/or modified sequence opt4 from Gemtuzumab_HeavyChain2
  source 1..351: mol_type = other RNA
caggtgcagctggtgcagagcggcgccgaggtgaagaagcccggcagcagcgtgaaggtgagctgcaaggccagcggcggcaccttcagcagaagcgccatcatctgggtgagacaggcccccggccagggcctggagtggatgggcggcatcgtgcccatgttcggcccccccaactacgcccagaagttccagggcagagtgaccatcaccgccgacgagagcaccaacaccgcctacatggagctgagcagcctgagaagcgaggacaccgccttctacttctgcgccggcggctacggcatctacagccccgaggagtacaacggcggcctggtgaccgtgagcagc

SEQ ID NO: 30900 - RNA, 321 nt, synthetic construct
  misc_feature 1..321: note = derived and/or modified sequence opt4 from Gemtuzumab_LightChain2
  source 1..321: mol_type = other RNA
gacatccagatgacccagagccccagcaccctgagcgccagcgtgggcgacagagtgaccatcacctgcagagccagccagagcatcaacacctggctggcctggtaccagcagaagcccggcaaggcccccaagctgctgatgtacaaggccagcagcctggagagcggcgtgcccagcagattcatcggcagcggcagcggcaccgagttcaccctgaccatcagcagcctgcagcccgacgacttcgccacctactactgccagcagtacaacagcgacagcaagatgttcggccagggcaccaaggtggaggtgaag

SEQ ID NO: 30901 - RNA, 318 nt, synthetic construct
  misc_feature 1..318: note = derived and/or modified sequence opt4 from Gemtuzumab_ozogamicin_LightChain1
  source 1..318: mol_type = other RNA
cagatcgtgctgacccagagccccgccatcatgagcgccagccccggcgagaaggtgaccatcacctgcagcgccagcagcagcatcagctacatgcactggttccagcagaagcccggcaccagccccaagctgtggatctacaccaccagcaacctggccagcggcgtgcccgccagattcagcggcagcggcagcggcaccagctacagcctgaccatcagcagaatggaggccgaggacgccgccacctactactgccaccagagaagcacctaccccctgaccttcggcagcggcaccaagctggagctgaag

SEQ ID NO: 30902 - RNA, 1335 nt, synthetic construct
  misc_feature 1..1335: note = derived and/or modified sequence opt4 from Gevokizumab_HeavyChain1
  source 1..1335: mol_type = other RNA
caggtgcagctgcaggagagcggccccggcctggtgaagcccagccagaccctgagcctgacctgcagcttcagcggcttcagcctgagcaccagcggcatgggcgtgggctggatcagacagcccagcggcaagggcctggagtggctggcccacatctggtgggacggcgacgagagctacaaccccagcctgaagagcagactgaccatcagcaaggacaccagcaagaaccaggtgagcctgaagatcaccagcgtgaccgccgccgacaccgccgtgtacttctgcgccagaaacagatacgaccccccctggttcgtggactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgaccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30903 - RNA, 642 nt, synthetic construct
  misc_feature 1..642: note = derived and/or modified sequence opt4 from Gevokizumab_LightChain1
  source 1..642: mol_type = other RNA
gacatccagatgacccagagcaccagcagcctgagcgccagcgtgggcgacagagtgaccatcacctgcagagccagccaggacatcagcaactacctgagctggtaccagcagaagcccggcaaggccgtgaagctgctgatctactacaccagcaagctgcacagcggcgtgcccagcagattcagcggcagcggcagcggcaccgactacaccctgaccatcagcagcctgcagcaggaggacttcgccacctacttctgcctgcagggcaagatgctgccctggaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30904 - RNA, 1347 nt, synthetic construct
  misc_feature 1..1347: note = derived and/or modified sequence opt4 from Girentuximab_HeavyChain1
  source 1..1347: mol_type = other RNA
gacgtgaagctggtggagagcggcggcggcctggtgaagctgggcggcagcctgaagctgagctgcgccgccagcggcttcaccttcagcaactactacatgagctgggtgagacagacccccgagaagagactggagctggtggccgccatcaacagcgacggcggcatcacctactacctggacaccgtgaagggcagattcaccatcagcagagacaacgccaagaacaccctgtacctgcagatgagcagcctgaagagcgaggacaccgccctgttctactgcgccagacacagaagcggctacttcagcatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30905 - RNA, 642 nt, synthetic construct
  misc_feature 1..642: note = derived and/or modified sequence opt4 from Girentuximab_LightChain1
  source 1..642: mol_type = other RNA
gacatcgtgatgacccagagccagagattcatgagcaccaccgtgggcgacagagtgagcatcacctgcaaggccagccagaacgtggtgagcgccgtggcctggtaccagcagaagcccggccagagccccaagctgctgatctacagcgccagcaacagatacaccggcgtgcccgacagattcaccggcagcggcagcggcaccgacttcaccctgaccatcagcaacatgcagagcgaggacctggccgacttcttctgccagcagtacagcaactacccctggaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30906 - RNA, 1335 nt, synthetic construct
  misc_feature 1..1335: note = derived and/or modified sequence opt4 from Glembatumumab_HeavyChain1
  source 1..1335: mol_type = other RNA
caggtgcagctgcaggagagcggccccggcctggtgaagcccagccagaccctgagcctgacctgcaccgtgagcggcggcagcatcagcagcttcaactactactggagctggatcagacaccaccccggcaagggcctggagtggatcggctacatctactacagcggcagcacctacagcaaccccagcctgaagagcagagtgaccatcagcgtggacaccagcaagaaccagttcagcctgaccctgagcagcgtgaccgccgccgacaccgccgtgtactactgcgccagaggctacaactggaactacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 30907 - RNA, 645 nt, synthetic construct
  misc_feature 1..645: note = derived and/or modified sequence opt4 from Glembatumumab_LightChain1
  source 1..645: mol_type = other RNA
gagatcgtgatgacccagagccccgccaccctgagcgtgagccccggcgagagagccaccctgagctgcagagccagccagagcgtggacaacaacctggtgtggtaccagcagaagcccggccaggcccccagactgctgatctacggcgccagcaccagagccaccggcatccccgccagattcagcggcagcggcagcggcaccgagttcaccctgaccatcagcagcctgcagagcgaggacttcgccgtgtactactgccagcagtacaacaactggcccccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30908 - RNA, 1332 nt, synthetic construct
  misc_feature 1..1332: note = derived and/or modified sequence opt4 from Goilixiab_HeavyChain1
  source 1..1332: mol_type = other RNA
gaggtgcagctggtggagagcggcggcggcctggccaagcccggcggcagcctgagactgagctgcgccgccagcggcttcagattcaccttcaacaactactacgactgggtgagacaggcccccggccagggcctggagtgggtgagcagaatcagcagcagcggcgaccccacctggtacgccgacagcgtgaagggcagattcaccatcagcagagagaacgccaagaacaccctgttcctgcagaacagcctgagagccgaggacaccgccgtgtactactgcgccagcctgaccaccggcagcgacagctggggccagggcgtgctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 30909 - RNA, 639 nt, synthetic construct
  misc_feature 1..639: note = derived and/or modified sequence opt4 from Goilixiab_LightChain1
  source 1..639: mol_type = other RNA
gacatccagacccagagccccagcagcctgagcgccagcgtgggcgacagagtgaccatcacctgcagagccagccaggacatcagatactacctgaactggtaccagcagaagcccggcaaggcccccaagctgctgatctacgtggccagcagcctgcagagcggcgtgcccagcagattcagcggcagcggcagcggcaccgagttcaccctgaccgtgagcagcctgcagcccgaggacttcgccacctactactgcctgcaggtgtacagcacccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 30910 - RNA, 1338 nt, synthetic construct
  misc_feature 1..1338: note = derived and/or modified sequence opt4 from Guselkumab_HeavyChain1
  source 1..1338: mol_type = other RNA
gaggtgcagctggtgcagagcggcgccgaggtgaagaagcccggcgagagcctgaagatcagctgcaagggcagcggctacagcttcagcaactactggatcggctgggtgagacagatgcccggcaagggcctggagtggatgggcatcatcgaccccagcaacagctacaccagatacagccccagcttccagggccaggtgaccatcagcgccgacaagagcatcagcaccgcctacctgcagtggagcagcctgaaggccagcgacaccgccatgtactactgcgccagatggtactacaagcccttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 30911 - RNA, 651 nt, synthetic construct
  misc_feature 1..651: note = derived and/or modified sequence opt4 from Guselkumab_LightChain1
  source 1..651: mol_type = other RNA
cagagcgtgctgacccagccccccagcgtgagcggcgcccccggccagagagtgaccatcagctgcaccggcagcagcagcaacatcggcagcggctacgacgtgcactggtaccagcagctgcccggcaccgcccccaagctgctgatctacggcaacagcaagagacccagcggcgtgcccgacagattcagcggcagcaagagcggcaccagcgccagcctggccatcaccggcctgcagagcgaggacgaggccgactactactgcgccagctggaccgacggcctgagcctggtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 30912 - RNA, 360 nt, synthetic construct
  misc_feature 1..360: note = derived and/or modified sequence opt4 from HuMab-001_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcggctactactggaactggatcagacagccccccggcaagggcctggagtggatcggcgagatcaaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagaggcaactacggcagcggctactactacttcgacctgtggggcagaggcacccaggtgaccgtgagcagc

SEQ ID NO: 30913 - RNA, 321 nt, synthetic construct
  misc_feature 1..321: note = derived and/or modified sequence opt4 from HuMab-001_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatcttcgccgccagcagcctgcagagcggcgtgcccagcagattcagcggcagcggcagcggcaccgacttcaccctgaccatcagcagcctgcagcccgaggacttcgccacctactactgccagcagtacatcagcttccccatcaccttcggccagggcaccagactggagatcaag

SEQ ID NO: 30914 - RNA, 366 nt, synthetic construct
  misc_feature 1..366: note = derived and/or modified sequence opt4 from HuMab-005_HeavyChain_gamma-Chain_VDJ-Region
  source 1..366: mol_type = other RNA
gaggtgcagctggtgcagagcggcgccgaggtgaagaagcccggcgagagcctgaagatcagctgcaaggccagcggctacagcttccacttctactggatcggctgggtgagacagatgcccggcaagggcctggagtggatgggcagcatctaccccggcgacagcgacaccagatacagacccagcttccagggccaggtgaccatcagcgccgacaagagcatcagcaccgcctacctgcagtggaccagcctgaaggccagcgacaccgccatctactactgcgccagacagagaggcgactactactacttctacggcatggacgtgtggggccagggcaccaccgtgaccgtgagcagc

SEQ ID NO: 30915 - RNA, 321 nt, synthetic construct
  misc_feature 1..321: note = derived and/or modified sequence opt4 from HuMab-005_LightChain_VJ-Region
  source 1..321: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggtgcccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcctgaccttcggcggcggcaccaaggtggagatcaag

SEQ ID NO: 30916 - RNA, 357 nt, synthetic construct
  misc_feature 1..357: note = derived and/or modified sequence opt4 from HuMab-006_HeavyChain_VDJ-Region
  source 1..357: mol_type = other RNA
gaggtgcagctgctggagagcggcggcggcctggtgcagcccggcggcagcctgagactgagctgcgccgccagcggcttcaccttcagcaactacgccctgatctgggtgagacaggcccccggcaagggcctggagtgggtgagcatcatcagaggcggcgccggcagcacctactacgccgacagcgtgaagggcagattcaccatcagcagagacaacagcaagaacaccctgtacctgcagatgaacagcctgagagccgaggacaccgccgtgtactactgcgccaaggccagaatctggggccccctgttcgactactggggccagggcaccctggtgaccgtgagcagc

SEQ ID NO: 30917 - RNA, 324 nt, synthetic construct
  misc_feature 1..324: note = derived and/or modified sequence opt4 from HuMab-006_LightChain_VJ-Region
  source 1..324: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccctgaccttcggcggcggcaccaaggtggagatcaag

SEQ ID NO: 30918 - RNA, 360 nt, synthetic construct
  misc_feature 1..360: note = derived and/or modified sequence opt4 from HuMab-019_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcgactactactggaactggatcagacagccccccggcaagggcctggagtggatcggcgagatccaccacgtgggcagcaccaactacaaccccagcctgaagagcagagtgaccatcagcgtggacaccagcaagagccagttcagcctgaagctgagcagcgtgaccgccgccgacaccgccgtgtactactgcgccagaggctactacgacagcggcgtgtactacttcgactactgggcccagggcaccctggtgaccgtgagcagc

SEQ ID NO: 30919 - RNA, 360 nt, synthetic construct
  misc_feature 1..360: note = derived and/or modified sequence opt4 from HuMab-021_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcgactactactggaactggatcagacagccccccggcaagggcctggagtggatcggcgagatccaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagaggctactacgccagcggcgtgtactacttcgactactggggccagggcaccctggtgaccgtgagcagc

SEQ ID NO: 30920 - RNA, 321 nt, synthetic construct
  misc_feature 1..321: note = derived and/or modified sequence opt4 from HuMab-021_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctaccccatcaccttcggccagggcaccagactggagatcaag

SEQ ID NO: 30921 - RNA, 360 nt, synthetic construct
  misc_feature 1..360: note = derived and/or modified sequence opt4 from HuMab-025_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcgactactactggaactggatcagacagccccccggcaagggcctggagtggatcggcgagatccaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagaggctactacgacagcggcgtgtactacttcgactactgggcccagggcaccctggtgaccgtgagcagc

SEQ ID NO: 30922 - RNA, 321 nt, synthetic construct
  misc_feature 1..321: note = derived and/or modified sequence opt4 from HuMab-025_LightChain_VJ-Region
  source 1..321: mol_type = other RNA
gacatccagatgacccagagccccagcagcctgagcgccagcgtgggcgacagagtgaccatcacctgcagagccagccagggcatcagcagatggctggcctggtaccagcagaagcccgagaaggcccccaagagcctgatctacgccgccagcagcctgagaagcggcgtgcccagcagattcagcggcagcggcagcggcaccgacttcaccctgaccatcagcagcctgcagcccgaggacttcgccacctactactgccagcagtacaacagctaccccatcaccttcggccagggcaccagactggagatcaag

SEQ ID NO: 30923 - RNA, 360 nt, synthetic construct
  misc_feature 1..360: note = derived and/or modified sequence opt4 from HuMab-027_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcgactacttctggaactggatcagacagccccccggcaagggcctggagtggatcggcgagatccaccacagcggcagcaccaactacaaccccagcctgaagagcagagtgaccatcagcgtggacaccagcaagaaccagttcagcctgaacctgagcagcgtgaccgccgccgacaccgccgtgtactactgcgccagaggcctgatcggcagcggctactactacttcgactactgggaccagggcaccctggtgaccgtgagcagc

SEQ ID NO: 30924 - RNA, 360 nt, synthetic construct
  misc_feature 1..360: note = derived and/or modified sequence opt4 from HuMab-032_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcggctactactggagctggatcagacagccccccggcaagggcctggagtggatcggcgagatcaaccacagcggcgacaccaactacaaccccagcctgaccagcagagtgaccatcagcgtggacaccagcaagaaccagttcagcctgaagctgagcagcgtgaccgccgccgacaccgccgtgtactactgcgccagactgttctacggcagcggcatctactacttcgactactggggccagggcaccctggtgaccgtgagcagc

SEQ ID NO: 30925 - RNA, 321 nt, synthetic construct
  misc_feature 1..321: note = derived and/or modified sequence opt4 from HuMab-032_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccaccttcagactgcagagcggcgtgcccagcagattcagcggcagcggcagcggcaccgacttcaccctgaccatcagcagcctgcagcccgaggacttcgccacctactactgccagcagtacaacagcttcccccccaccttcggccagggcaccaaggtggagatcaag

SEQ ID NO: 30926 - RNA, 363 nt, synthetic construct
  misc_feature 1..363: note = derived and/or modified sequence opt4 from HuMab-033_HeavyChain_VDJ-Region
  source 1..363: mol_type = other RNA
caggtgcagctggtggagagcggcggcggcgtggtgcagaccggcagaagcctgagactgagctgcgccgccagcggcttcaccttcagcagccacgccatgcactgggtgagacaggcccccggcaagggcctggagtgggtggccgccatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccagaggcgactacatcagcagcagcggcgtgttcgactactggggccagggcaccctggtgaccgtgagcagc

SEQ ID NO: 30927 - RNA, 360 nt, synthetic construct
  misc_feature 1..360: note = derived and/or modified sequence opt4 from HuMab-035_HeavyChain_VDJ-Region
  source 1..360: mol_type = other RNA
caggtgcagctgcagcagtggggcgccggcctgctgaagcccagcgagaccctgagcctgacctgcgccatctacggcggcagcttcagcggctactactggagctggatcagacagccccccggcaagggcctggagtggatcggcgagatcaaccacagcggcgacaccaactacaaccccagcctgaccagcagagtgaccatcagcgtggacaccagcaagaaccagttcagcctgaagctgagcagcgtgaccgccgccgacaccgccgtgtactactgcgccagactgttctacggcagcggcatctactacttcgactactggggccagggcaccctggtgaccgtgagcagc

SEQ ID NO: 30928 - RNA, 360 nt, synthetic construct
  misc_feature 1..360: note = derived and/or modified sequence opt4 from HuMab-036_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcgactactactggagctggatcagacagccccccggcaagggcctggagtggatcggcgagatcaaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagactgtactacggcagcggcacctactacttcgactactggggccagggcaccctggtgaccgtgagcagc

SEQ ID NO: 30929 - RNA, 321 nt, synthetic construct
  misc_feature 1..321: note = derived and/or modified sequence opt4 from HuMab-036_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctgacctggtaccagcagaagcccgagaaggcccccaagagcctgatctacgccgccagcagactgcagagcggcgtgcccagcagattcagcggcagcggcagcggcaccgacttcaccctgaccatcagcagcctgcagcccgaggacttcgccacctactactgccagcagtacaacagcttcccccccaccttcggccagggcaccaaggtggagatcaag

SEQ ID NO: 30930 - RNA, 366 nt, synthetic construct
  misc_feature 1..366: note = derived and/or modified sequence opt4 from HuMab-041_HeavyChain_VDJ-Region
  source 1..366: mol_type = other RNA
gaggtgcagctggtgcagagcggcgccgaggtgaagaagcccggcgagagcctgaagatcagctgcaagggcagcggctacagcttcaccagctactggatcggctgggtgagacagatgcccggcaagggcctggagtggatgggcagcatctaccccggcgacagccacaccagatacagacccagcttccagggccaggtgaccatcagcgccgacaagagcatcagcaccgcctacctgcagtggagcagcctgaaggccagcgacaccgccatgtactactgcgccagacagaagggcgacttctactacttcttcggcctggacgtgtggggccagggcaccgccatcaccgtgagcagc

SEQ ID NO: 30931 - RNA, 366 nt, synthetic construct
  misc_feature 1..366: note = derived and/or modified sequence opt4 from HuMab-044_HeavyChain_VDJ-Region
  source 1..366: mol_type = other RNA
gaggtgcagctggtgcagagcggcgccgaggtgaagaagcccggcgagagcctgaagatcagctgcaagggcagcggctacagattcagcagctactggatcggctgggtgagacagatgcccggcaagggcctggagtggatgggcagcatcttccccggcgacagcgacaccagatacagccccagcttccagggccaggtgaccatcagcgccgacaagagcatcaccaccgcctacctgcagtggagcagcctgaaggccagcgacaccgccatgtactactgcgccagacaggccggcgactactactactacaacggcatggacgtgtggggccagggcaccaccgtgaccgtgagcagc

SEQ ID NO: 30932 - RNA, 357 nt, synthetic construct
  misc_feature 1..357: note = derived and/or modified sequence opt4 from HuMab-049_HeavyChain_VDJ-Region
  source 1..357: mol_type = other RNA
gaggtgcagctgctggagagcggcggcgacctggtgcagcccggcggcagcctgagactgagctgcgccgccagcggcttcaccttcagcagctacgccatgagctgggtgagacaggcccccggcaagggcctggagtgggtgagcgccatcagcggcagaggcggcaccacctactacgccgacagcgtgaagggcagattcaccatcagcagagacaacagcaagagcaccctgtgcctgcagatgaacagcctgagagccgaggacaccgccgtgtactactgcgccaaggccagagccaactgggactacttcgactactggggccagggcaccctggtgaccgtgagcagc

SEQ ID NO: 30933 - RNA, 321 nt, synthetic construct
  misc_feature 1..321: note = derived and/or modified sequence opt4 from HuMab-049_LightChain_VJ-Region
  source 1..321: mol_type = other RNA
gacatccagatgacccagagccccagcagcgtgagcgccagcgtgggcgacagagtgaccatcacctgcagagccagccagggcatcagcagctggctggcctggtaccagcacaagcccggcaaggcccccaagctgctgatctacgccgccagcatcctgcagagcggcgtgcccagcagattcagcggcagcggcagcggcaccgacttcaccctgaccatcagcagcctgagacccgaggacttcgccacctactactgccagcaggccaacagcttccccatcaccttcggccagggcaccagactggagatcaag

SEQ ID NO: 30934 - RNA, 357 nt, synthetic construct
  misc_feature 1..357: note = derived and/or modified sequence opt4 from HuMab-050_HeavyChain_VDJ-Region
  source 1..357: mol_type = other RNA
gaggtgcagctgctggagagcggcggcggcctggtgcagcccggcggcagcctgagactgagctgcgccgccagcggcttcaccttcagcagctacgccatgaactgggtgagacaggcccccggcaagggcctggagtgggtgagcgccatcagcggcagaggcggcaccacctactacgccgacagcgtgaagggcagattcaccatcagcagagacaacagcaagaacaccctgtacctgcagatgagcagcctgagagccgaggacaccgccgtgtactactgcgccaaggccagagccaactgggactacttcgactactggggccagggcaccctggtgaccgtgagcagc

SEQ ID NO: 30935 - RNA, 321 nt, synthetic construct
  misc_feature 1..321: note = derived and/or modified sequence opt4 from HuMab-050_LightChain_VJ-Region
  source 1..321: mol_type = other RNA
gacatccagatgacccagagccccagcagcgtgagcgccagcgtgggcgacagagtgaccatcacctgcagagccagccagggcatcagcagctggctggcctggtaccagcacaagcccggcaaggcccccaagctgctgatctacgccgccagcatcctgcagagcggcgtgcccagcagattcagcggcagcggcagcggcaccgacttcaccctgaccatcagcagcctgcagcccgaggacttcgccacctactactgccagcaggccaacagcttccccatcaccttcggccagggcaccagactggagatcaag

SEQ ID NO: 30936 - RNA, 360 nt, synthetic construct
  misc_feature 1..360: note = derived and/or modified sequence opt4 from HuMab-054_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcggctactactggagctggatcagacagccccccggcaagggcctggagtggatcggcgagatccaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagactgtggtacggcagcggcagctactacttcgactactggggccagggcaccctggtgaccgtgagcagc

SEQ ID NO: 30937 - RNA, 321 nt, synthetic construct
  misc_feature 1..321: note = derived and/or modified sequence opt4 from HuMab-054_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagcttcccccccaccttcggcggcggcaccaaggtggagatcaag

SEQ ID NO: 30938 - RNA, 357 nt, synthetic construct
  misc_feature 1..357: note = derived and/or modified sequence opt4 from HuMab-055_HeavyChain_VDJ-Region
  source 1..357: mol_type = other RNA
gaggtgcagctgctggagagcggcggcggcctggtgcagcccggcggcagcctgagactgagctgcgccgccagcggcttcaccttcagcagctacgccatgaactgggtgagacaggcccccggcaagggcctggagtgggtgagcgccatcagcggcagaggcggcaccacctactacgccgacagcgtgaagggcagattcaccatcagcagagacaacagcaagagcaccctgtgcctgcagatgaacagcctgagagccgaggacaccgccgtgtactactgcgccaaggccagagccaactgggactacttcgactactggggccagggcaccctggtgaccgtgagcagc

SEQ ID NO: 30939 - RNA, 366 nt, synthetic construct
  misc_feature 1..366: note = derived and/or modified sequence opt4 from HuMab-059_HeavyChain_VDJ-Region
  source 1..366: mol_type = other RNA
caggtgcagctggtgcagagcggcgccgaggtgaagaagcccggcgccagcgtgagagtgccctgcaaggccagcggctacaccttcaccagatacggcatcagctgggtgagacaggcccccggccagggcctggagtggatgggctggatcagcgcctacaacggcaagacctactacgcccagaagctgcagggcagagtgaccatgaccaccgacaccagcaccagcaccgcctacatggagctgagaagcctgagaagcgacgacaccgccgtgtactactgcgccagaagccccctgctgtggttcgaggagctgtacttcgactactggggccagggcaccctggtgaccgtgagcagc

SEQ ID NO: 30940 - RNA, 324 nt, synthetic construct
  misc_feature 1..324: note = derived and/or modified sequence opt4 from HuMab-059_LightChain_VJ-Region
  source 1..324: mol_type = other RNA
gagatcgtgctgacccagagccccggcaccctgagcctgagccccggcgagagagccaccctgagctgcagagccagccagagcgtgagcagcacctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcaccagcctgttcaccttcggccccggcaccaaggtggacatcaag

SEQ ID NO: 30941 - RNA, 366 nt, synthetic construct
  misc_feature 1..366: note = derived and/or modified sequence opt4 from HuMab-060_HeavyChain_VDJ-Region
  source 1..366: mol_type = other RNA
gaggtgcagctggtgcagagcggcgccgaggtgaagaagcccggcgagagcctgaagatcagctgcaagggcagcggctacagattcaccagctactggatcggctgggtgagacagatgcccggcaagggcctggagtggatgggcagcatctaccccggcgacagctacaccagaaacagccccagcttccagggccaggtgaccatcagcgccgacaagagcatcgccaccgcctacctgcagtggaacagcctgaaggccagcgacaccgccatgtactactgcgccagacacgccggcgacttctactacttcgacggcctggacgtgtggggccagggcaccaccgtgaccgtgagcagc

SEQ ID NO: 30942 - RNA, 327 nt, synthetic construct
  misc_feature 1..327: note = derived and/or modified sequence opt4 from HuMab-060_LightChain_VJ-Region
  source 1..327: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcccccccatcaccttcggccagggcaccagactggagatcaag

SEQ ID NO: 30943 - RNA, 366 nt, synthetic construct
  misc_feature 1..366: note = derived and/or modified sequence opt4 from HuMab-067_HeavyChain_VDJ-Region
  source 1..366: mol_type = other RNA
gaggtgcagctggtgcagagcggcgccgaggtgaagaagcccggcgagagcctgaagatcagctgcaagggcagcggctacagcttcaccagctactggatcggctgggtgagacagatgcccggcaagggcctggagtggatgggcatcatctaccccggcgacagcgacaccagatacagccccagcttccagggccaggtgaccatcagcgtggacaagagcatcagcaccgcctacctgcagtggagcagcctgaaggccagcgacaccgccatgtactactgcgccagacagaagggcgactactactaccactacggcctggacgtgtggggccagggcaccaccgtgaccgtgagcagc

SEQ ID NO: 30944 - RNA, 366 nt, synthetic construct
  misc_feature 1..366: note = derived and/or modified sequence opt4 from HuMab-072_HeavyChain_VDJ-Region
  source 1..366: mol_type = other RNA
gaggtgcagctggtgcagagcggcgccgaggtgaagaagcccggcgagagcctgaagatcagctgcaagggcagcggctacagcttcaccagctactggatcggctgggtgagacagatgcccggcaagggcctggagtggatgggcatcatctaccccggcgacagcgacaccagatacagccccagcttccagggccaggtgaccatcagcgccgacaagagcatcagcaccgcctacctgcagtggagcagcctgaaggccagcgacaccgccatgtactactgcgccagacagaagggcgactactactacttcaacggcctggacgtgtggggccagggcaccaccgtgaccgtgagcagc

SEQ ID NO: 30945 - RNA, 327 nt, synthetic construct
  misc_feature 1..327: note = derived and/or modified sequence opt4 from HuMab-072_LightChain_VJ-Region
  source 1..327: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccagactgaccttcggcggcggcaccaaggtggagatcaag

SEQ ID NO: 30946 - RNA, 363 nt, synthetic construct
  misc_feature 1..363: note = derived and/or modified sequence opt4 from HuMab-084_HeavyChain_VDJ-Region
  source 1..363: mol_type = other RNA
caggtgcagctggtgcagagcggcgccgaggtgaagaagcccggcagcagcgtgaaggtgagctgcaaggccagcggcggcaccttcagaacctacgccatcaactgggtgagacaggcccccggccagggcctggagtggatgggcagaatcaacaccgtgctgggcatcgtgaaccacgcccagaagttccagggcagagtgaccatcaccgccgacaagagcaccaacaccgcctacatggagctgaacagcctgagaagcgaggacaccgccgtgtactactgcgccagagagaagggcgtggactactactacggcatcgaggtgtggggccagggcaccaccgtgaccgtgagcagc

SEQ ID NO: 30947 - RNA, 321 nt, synthetic construct
  misc_feature 1..321: note = derived and/or modified sequence opt4 from HuMab-084_LightChain_VJ-Region
  source 1..321: mol_type = other RNA
gacatccagatgacccagagccccagcagcgtgagcgccagcgtgggcgacagagtgaccatcacctgcagagccagccagggcatcagcagctggctggcctggtaccagcacaagcccggcaaggcccccaagctgctgatctacgtggccagcaccctgcagagcggcgtgcccagcagattcagcggcagcggcagcggcaccgacttcaccctgaccatcagcagcctgcagcccgaggacttcgccacctactactgccagcaggccaacagcttccccctgaccttcggcggcggcaccaaggtggagatcaag

SEQ ID NO: 30948 - RNA, 360 nt, synthetic construct
  misc_feature 1..360: note = derived and/or modified sequence opt4 from HuMab-091_HeavyChain_VDJ-Region
  source 1..360: mol_type = other RNA
caggtgcagctgcagcagtggggcgccggcctgctgaagcccagcgagaccctgagcctgacctgcgccgtgagcggcggcagcttcagcggctactactggacctggatcagacagccccccggcaagggcctggagtggatcggcgagatctaccacagcggcgacaccaactacaaccccagcctgaagagcagagtgaccatcagcgtggacaccagcaagaaccagttcagcctgaagctgtacagcgtgaccgccgccgacaccgccgtgtactactgcgccagactgtacttcggcagcggcatctactacctggactactggggccagggcaccctggtgaccgtgagcagc

SEQ ID NO: 30949 - RNA, 321 nt, synthetic construct
  misc_feature 1..321: note = derived and/or modified sequence opt4 from HuMab-091_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggtgtggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagcttcccccccaccttcggccagggcaccaaggtggagatcaag

SEQ ID NO: 30950 - RNA, 366 nt, synthetic construct
  misc_feature 1..366: note = derived and/or modified sequence opt4 from HuMab-093_HeavyChain_VDJ-Region
  source 1..366: mol_type = other RNA
gaggtgcagctggtgcagagcggcgccgaggtgaagaagcccggcgagagcctgaagatcagctgcaagggcagcggctacagcttcaccagctactggatcggctgggtgagacagatgcccggcaagggcctggagtggatgggcagaatctaccccggcgacagcgacaccagatacagccccagcttccagggccaggtgaccatcagcgccgacaagagcatcaccaccgcctacctgcagtggagcagcctgagagccagcgacaccgccatgtactactgcgccagacagagaggcgactactactacttcttcggcctggacatctggggccagggcaccaccgtgaccgtgagcctg

SEQ ID NO: 30951 - RNA, 372 nt, synthetic construct
  misc_feature 1..372: note = derived and/or modified sequence opt4 from HuMab-098_HeavyChain_VDJ-Region
  source 1..372: mol_type = other RNA
gaggtgcagctgctggagagcggcggcggcctggtgcagcccggcggcagcctgagactgagctgcgccgccagcggcttcaccttcagcaactacggcatgagctgggtgagacaggcccccggcaagggcctggagtgggtgagcgccatcagcggcagcgcctacagcacctactacgccgacagcgtgaagggcagattcaccatcagcagagacaacagcaagaacaccctgtggctgcagatgaacagcctgagagccgaggacaccgccgtgtactactgcgccaaggcccactaccacggcagcggcagctactacaccctgttcgactactggggccagggcaccctggtgaccgtgagcagc

SEQ ID NO: 30952 - RNA, 321 nt, synthetic construct
  misc_feature 1..321: note = derived and/or modified sequence opt4 from HuMab-098_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccctacaccttcggccagggcaccaagctggagatcaag

SEQ ID NO: 30953 - RNA, 372 nt, synthetic construct
  misc_feature 1..372: note = derived and/or modified sequence opt4 from HuMab-100_HeavyChain_VDJ-Region
  source 1..372: mol_type = other RNA
gaggtgcagctgctggagagcggcggcggcctggtgcagcccggcggcagcctgagactgagctgcgccgccagcggcttcaccttcaacaactacggcatgaactgggtgagacaggcccccggcaagggcctggagtgggtgagcgccatcagcggcaccggctacagcacctactacgccgacagcgtgaagggcagattcaccatcagcagagacaacagcaagaacaccctgtacctgcagatgaacagcctgagagccgaggacaccgccgtgtactactgcgccaaggcccactacttcggcagcggcagctactacaccctgttcgactactggggccagggcaccctggtgaccgtgagcagc

SEQ ID NO: 30954 - RNA, 372 nt, synthetic construct
  misc_feature 1..372: note = derived and/or modified sequence opt4 from HuMab-106_HeavyChain_VDJ-Region
  source 1..372: mol_type = other RNA
gaggtgcagctggtgcagagcggcgccgaggtgaagaagcccggcgagagcctgaagatcagctgcaagggcagcggctacagcttcaccagatactggatcggctgggtgagacagatgcccggcaagggcctggagtggatgggcatcatctaccccggcgacagcgacaccagatacagccccagcttccagggccaggtgaccatcagcgccgacaagagcatcagcaccgcctacctgcagtggagcagcctgaaggccagcgacaccgccatgtactactgcgccagactgaccggcgacagaggcttcgactactacagcggcatggacgtgtggggccagggcaccaccgtgaccgtgagcagc

SEQ ID NO: 30955 - RNA, 321 nt, synthetic construct
  misc_feature 1..321: note = derived and/or modified sequence opt4 from HuMab-106_LightChain_VJ-Region
  source 1..321: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcttcaccttcggccccggcaccaaggtggacatcaag

SEQ ID NO: 30956 - RNA, 351 nt, synthetic construct
  misc_feature 1..351: note = derived and/or modified sequence opt4 from HuMab_10F8_HeavyChain_V-Region
  source 1..351: mol_type = other RNA
caggtgcagctggtggagagcggcggcggcgtggtgcagcccggcagaagcctgagactgagctgcaccgccagcggcttcaccttcagccactacggcatgtactgggtgagacaggcccccggcaagggcctggagtgggtggccgtgatctggtacgacggcagctacgagtacaacgaggacagcgtgaagggcagattcaccatcagcagagacaacagcaagaacaccctgtacctgcagatgaacagcctgagagccgaggacaccgccgtgtactactgcgccagagacagagtgggcctgttcgactactggggccagggcaccctggtgaccgtgagcagc

SEQ ID NO: 30957 - RNA, 408 nt, synthetic construct
  misc_feature 1..408: note = derived and/or modified sequence opt4 from HuMab_10F8_HeavyChain_V-Region_Precursor
  source 1..408: mol_type = other RNA
atggagttcggcctgagctgggtgttcctggtggccctgctgagaggcgtgcagtgccaggtgcagctggtggagagcggcggcggcgtggtgcagcccggcagaagcctgagactgagctgcaccgccagcggcttcaccttcagccactacggcatgtactgggtgagacaggcccccggcaagggcctggagtgggtggccgtgatctggtacgacggcagctacgagtacaacgccgacagcgtgaagggcagattcaccatcagcagagacaacagcaagaacaccctgtacctgcagatgaacagcctgagagccgaggacaccgccgtgtactactgcgccagagacagagtgggcctgttcgactactggggccagggcaccctggtgaccgtgagcagc

SEQ ID NO: 30958 - RNA, 321 nt, synthetic construct
  misc_feature 1..321: note = derived and/or modified sequence opt4 from HuMab_10F8_LightChain_V-Region
  source 1..321: mol_type = other RNA
gagatcgtgctgacccagagccccggcaccctgagcctgagccccggcgagagagccaccctgagctgcagagccagccagagcatcagcagcagctacctggcctggtaccagcagaagcccggccaggcccccagactgctgatctacggccccagcagcagagccaccggcatccccgacagattcagcggcagcggcagcggcaccgacttcaccctgaccatcagcagactggagcccgaggacttcgccgtgtactactgccagcagtacgccggcagcctgaccttcggccccggcaccaaggtggacatcaag

SEQ ID NO: 30959 - RNA, 381 nt, synthetic construct
  misc_feature 1..381: note = derived and/or modified sequence opt4 from HuMab_10F8_LightChain_V-Region_Precursor
  source 1..381: mol_type = other RNA
atggagacccccgcccagctgctgttcctgctgctgctgtggctgcccgacaccaccggcgagatcgtgctgacccagagccccggcaccctgagcctgagccccggcgagagagccaccctgagctgcagagccagccagagcatcagcagcagctacctggcctggtaccagcagaagcccggccaggcccccagactgctgatctacggccccagcagcagagccaccggcatccccgacagattcagcggcagcggcagcggcaccgacttcaccctgaccatcagcagactggagcccgaggacttcgccgtgtactactgccagcagtacgccggcagcctgaccttcggccccggcaccaaggtggacatcaag

SEQ ID NO: 30960 - RNA, 357 nt, synthetic construct
  misc_feature 1..357: note = derived and/or modified sequence opt4 from HuMab-111_HeavyChain_VDJ-Region
  source 1..357: mol_type = other RNA
caggtgcagctggtgcagagcggcgccgaggtgaagaagcccggcagcagcgtgaaggtgagctgcaaggccagcggcggcaccttcagcagctacggcatcagctgggtgagacaggcccccggccccggcctggagtggatgggcagaatcatccccatcctgggcatcgccaactacgcccagaagttccagggcagagtgaccatcaccgccgacaagagcaccaacaccgcctacatggagctgagcagcctgagaagcgaggacaccgccgtgtactactgcgccagagaccaggagtacagcagcaactggtactactggggccagggcaccctggtgaccgtgagcagc

SEQ ID NO: 30961 - RNA, 321 nt, synthetic construct
  misc_feature 1..321: note = derived and/or modified sequence opt4 from HuMab-111_LightChain_VJ-Region
  source 1..321: mol_type = other RNA
gagatcgtgctgacccagagccccggcaccctgagcctgagccccggcgagagagccaccctgagctgcagagccagccagagcgtgagaagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagctgtacggcagcagccccaccttcggccccggcaccaaggtggacatcaag

SEQ ID NO: 30962 - RNA, 363 nt, synthetic construct
  misc_feature 1..363: note = derived and/or modified sequence opt4 from HuMab-123_HeavyChain_VDJ-Region
  source 1..363: mol_type = other RNA
caggtgcagctggtgcagagcggcgccgaggtgaagaagcccggcgccagcgtgaaggtgagctgcaaggccgccggctacaccttcaccaactacggcatcagctgggtgagacaggcccccggccaggccctggagtggatgggctggatcaccacctacagcagcaacaccatctacgcccagaagctgcagggcagagtgaccatgaccaccgacaccagcaccagcaccgcctacatggagctgagaagcctgagaagcgacgacaccgccgtgtactactgcgccagagacagagtggtggtgagacccgactacttcgactactggggccagggcaccctggtgaccgtgagcagc

SEQ ID NO: 30963 - RNA, 321 nt, synthetic construct
  misc_feature 1..321: note = derived and/or modified sequence opt4 from HuMab-123_LightChain_VJ-Region
  source 1..321: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacaccagcaacagagccaccggcatccccgccagattcagcggcagcggcagcggcaccgacttcaccctgaccatcagcagcctggagcccgaggacttcgccgtgtactactgccagcagagaagccactggcccagaaccttcggccagggcaccaaggtggagatcaag

SEQ ID NO: 30964 - RNA, 363 nt, synthetic construct
  misc_feature 1..363: note = derived and/or modified sequence opt4 from HuMab-124_HeavyChain_VDJ-Region
  source 1..363: mol_type = other RNA
caggtgcagctggtgcagagcggcgccgaggtgaagaagcccggcgccagcgtgaaggtgagctgcaaggccgccggctacaccttcaccaactacggcatcagctgggtgagacaggcccccggccagggcctggagtggatgggctggatcatcacctacaacggcaacaccatctacgcccagagattccaggacagagtgaccatgaccaccgacaccagcaccagcaccgcctacatggagctgagaagcctgagaagcgacgacaccgccgtgtactactgcgccagagacagaatcatcgtgagacccgactacttcgactactggggccagggcaccctggtgaccgtgagcagc

SEQ ID NO: 30965 - RNA, 372 nt, synthetic construct
  misc_feature 1..372: note = derived and/or modified sequence opt4 from HuMab-125_HeavyChain_VDJ-Region
  source 1..372: mol_type = other RNA
gaggtgcagctgctggagagcggcggcggcctggtgcagcccggcggcagcctgagactgagctgcgccgccagcggcttcaccttcaccgactacgccatgaactgggtgagacaggcccccggcaagggcctggagtgggtgagcaccatcagcggcagcggctacgccacctactacgccgacagcgtgaagggcagattcaccatcagcagagacaacagcaagaccaccctgtacctgcagatgaacagcctgagagccgaggacaccgccgtgtactactgcgccaagggccacaccctgggcagcggcagctactacaccctgttcgactactggggccagggcaccctggtgaccgtgagcagc

SEQ ID NO: 30966 - RNA, 321 nt, synthetic construct
  misc_feature 1..321: note = derived and/or modified sequence opt4 from HuMab-125_LightChain_VJ-Region
  source 1..321: mol_type = other RNA
gacatccagatgacccagagccccagcagcctgagcgccagcgtgggcgacagagtgaccatcacctgcagagccagccagggcatcaacagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccctacaccttcggccagggcaccaagctggagatcaag

SEQ ID NO: 30967 - RNA, 369 nt, synthetic construct
  misc_feature 1..369: note = derived and/or modified sequence opt4 from HuMab-127_HeavyChain_VDJ-Region
  source 1..369: mol_type = other RNA
gaggtgcagctggtgcagagcggcgccgaggtgaagaagcccggcgagagcctgaccatcagctgcaagggcagcggctacagcttcagcatctactggatcggctgggtgagacagatgcccggcaagggcctggagtggatgggcatcatcttccccggcgacagcgacatcagatacagccccagcttccagggccaggtgaccatcagcgccgacaagagcatcagcaccgcctacctgcagtggagcagcctgaaggccagcgacaccgccatgtactactgcgccagacagcccggcgactggagccccagacactggtacttcgacctgtggggcagaggcaccctggtgaccgtgagcagc

SEQ ID NO: 30968 - RNA, 321 nt, synthetic construct
  misc_feature 1..321: note = derived and/or modified sequence opt4 from HuMab-127_LightChain_VJ-Region
  source 1..321: mol_type = other RNA
gtgatctggatgacccagagccccagcctgctgagcgccagcaccggcgacagagtgaccatcagctgcagaatgagccagggcatcagcagctacctggcctggtaccagcagaagcccggcaaggcccccgagctgctgatctacgccgccagcaccctgcagagcggcgtgcccagcagattcagcggcagcggcagcggcaccgacttcaccctgaccatcagctacctgcagagcgaggacttcgccacctactactgccagcagtactacagcttccccctgaccttcggcggcggcaccaaggtggagatcaag

SEQ ID NO: 30969 - RNA, 357 nt, synthetic construct
  misc_feature 1..357: note = derived and/or modified sequence opt4 from HuMab-129_HeavyChain_VDJ-Region
  source 1..357: mol_type = other RNA
caggtgcagctggtggagagcggcggcggcgtggtgcagcccggcagaagcctgagactgagctgcgccgccagcggcttcaccttcagcaccttcgccatccactgggtgagacaggcccccggcaagggcctggagtgggtggccgtgatcagctacgacggcggccacaagttctacgccgacagcgtgaagggcagattcaccatcagcagagacaacagcaagaacaccctgtacctgcagatgaacagcctgagagccgaggacaccgccatgtactactgcgccagaggcctgggcgtgtggggcgccttcgactactggggccagggcaccctggtgaccgtgagcagc

SEQ ID NO: 30970 - RNA, 318 nt, synthetic construct
  misc_feature 1..318: note = derived and/or modified sequence opt4 from HuMab-129_LightChain_VJ-Region
  source 1..318: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggtggaccttcggccagggcaccaaggtggagatcaag

SEQ ID NO: 30971 - RNA, 375 nt, synthetic construct
  misc_feature 1..375: note = derived and/or modified sequence opt4 from HuMab-132_HeavyChain_VDJ-Region
  source 1..375: mol_type = other RNA
caggtgcagctggtgcagagcggcgccgaggtgaagaagcccggcgccagcgtgaaggtgagctgcaaggccagcggctacaccttcaccagctacggcatcagctgggtgagacaggcccccggccagggcctggagtggatgggctggatcagcgcctacaacggcaacagcaactacgtgcagaagttccagggcagagtgaccatgaccaccgacaccaccaccagcaccgcctacatggagctgagaagcctgaccagcgacgacaccgccgtgtactactgcgccagagagtacagctacgacagcggcacctacttctactacggcatggacgtgtggggccagggcaccaccgtgaccgtgagcagc

SEQ ID NO: 30972 - RNA, 324 nt, synthetic construct
  misc_feature 1..324: note = derived and/or modified sequence opt4 from HuMab-132_LightChain_VJ-Region
  source 1..324: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccatgtacaccttcggccagggcaccaagctggagatcaag

SEQ ID NO: 30973 - RNA, 360 nt, synthetic construct
  misc_feature 1..360: note = derived and/or modified sequence opt4 from HuMab-143_HeavyChain_VDJ-Region
  source 1..360: mol_type = other RNA
caggtgcagctgcagcagtggggcgccggcctgctgaagcccagcgagaccctgagcctgacctgcgccgtgtacggcggcagcttcagcggctactactggaactggatcagacagccccccggcaagggcctggagtggatcggcgagatccaccacagcggcagcgccaactacaaccccagcctgatgagcagagtgaccatcagcgtggacaccagcaagaaccagttcagcctgcagctgagcagcgtgaccgccgccgacaccgccgtgtactactgcgccagaggctactacggcagcggctactactacttcgactactggggccagggcaccctggtgaccgtgagcagc

SEQ ID NO: 30974 - RNA, 321 nt, synthetic construct
  misc_feature 1..321: note = derived and/or modified sequence opt4 from HuMab-143_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagactgcagagcggcgtgcccagcagattcagcggcagcggcagcggcaccgacttcaccctgaccatcagcagcctgcagcccgaggacttcgccacctactactgccagcagtacaacagctaccccatcaccttcggccagggcaccagactggagatcaag

SEQ ID NO: 30975 - RNA, 366 nt, synthetic construct
  misc_feature 1..366: note = derived and/or modified sequence opt4 from HuMab-150_HeavyChain_VDJ-Region
  source 1..366: mol_type = other RNA
gaggtgcagctggtgcagagcggcgccgaggtgaagaagcccggcgagagcctgaagatcagctgcaagggcagcggctacagcttcaccagctactggatcggctgggtgagacagatgcccggcaagggcctggagtggatgggcagcatctaccccggcgacagccacaccagatacagacccagcttccagggccaggtgaccatcagcgccgacaagagcatcagcaccgcctacctgcagtggagcagcctgaaggccagcgacaccgccatgtactactgcgccagacaggccggcgactactactactacaacggcatggacgtgtggggccagggcaccaccgtgaccgtgagcagc

SEQ ID NO: 30976 - RNA, 321 nt, synthetic construct
  misc_feature 1..321: note = derived and/or modified sequence opt4 from HuMab-150_LightChain_VJ-Region
  source 1..321: mol_type = other RNA
gagatcgtgctgacccagagccccggcaccctgagcctgagccccggcgagagagccaccctgagctgcagagccagccagagcgtgagcagcagctacctgacctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcctgaccttcggcggcggcaccaaggtggagatcaag

SEQ ID NO: 30977 - RNA, 363 nt, synthetic construct
  misc_feature 1..363: note = derived and/or modified sequence opt4 from HuMab-152_HeavyChain_VDJ-Region
  source 1..363: mol_type = other RNA
caggtgcaggtggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagctacaagtactacgccgacagcgtgaagggcagattcaccatcagcagagacaacagcaagaacaccctgtacctgcagatgaacagcctgagagccgaggacaccgccgtgtactactgcgccagaggcagcatcaccggcagcaccggcgtgttcgactactggggccagggcaccctggtgaccgtgagcagc

SEQ ID NO: 30978 - RNA, 321 nt, synthetic construct
  misc_feature 1..321: note = derived and/or modified sequence opt4 from HuMab-152_LightChain_VJ-Region
  source 1..321: mol_type = other RNA
gacatccagatgacccagagccccagcagcctgagcgccagcgtgggcgacagagtgaccatcacctgcagagccagccagggcatcaacagctggctggcctggtaccagcagaagcccgagaaggcccccaagagcctgatctacgacgccagcagcctgcagagcggcgtgcccagcagattcagcggcagcggcagcggcaccgacttcaccctgaccatcagcagcctgcagcccgagaacttcgccacctactactgccagcagtacaacagctaccccatcaccttcggccagggcaccagactggagatcaag

SEQ ID NO: 30979 - RNA, 363 nt, synthetic construct
  misc_feature 1..363: note = derived and/or modified sequence opt4 from HuMab-153_HeavyChain_VDJ-Region
  source 1..363: mol_type = other RNA
caggtgcagctggtggagagcggcggcggcgtggtgcagcccggcagaagcctgagactgagctgcgccgccagcggcttcaccttcagcgactacgtgatccactgggtgagacaggcccccggcaagggcctggagtgggtgaccgtgatcagctacgacggcagcaacaagtactacgccgacagcgtgaagggcagattcaccatcagcagagacaacagcaagaacaccctgtacctgcagatgaacagcctgagcgccgaggacaccgccatgtactactgcgccagaggcggcatcaccggcaccaccggcgtgttcgactactggggccagggcaccctggtgaccgtgagcagc

SEQ ID NO: 30980 - RNA, 321 nt, synthetic construct
  misc_feature 1..321: note = derived and/or modified sequence opt4 from HuMab-153_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgacgccagcagcctgcagagcggcgtgcccagcagattcagcggcagcggctacggcaccgacttcagcctgaccatcagcagcctgcagcccgaggacttcgccatctactactgccagcagtacaagagctaccccatcaccttcggccagggcaccagactggagatcaag

SEQ ID NO: 30981 - RNA, 378 nt, synthetic construct
  misc_feature 1..378: note = derived and/or modified sequence opt4 from HuMab-159_HeavyChain_VDJ-Region
  source 1..378: mol_type = other RNA
gaggtgcagctggtgcagagcggcgccgaggtgaagaagcccggcgagagcctgaagatcagctgcaagggcagcggctacaacttcaccagctactggatcggctgggtgagacagatgcccggcaagggcctggagtggatgggcatcatctaccccggcgacagcgacaccagatacagccccagcttccagggccaggtgaccatcagcgccgacaagagcatcagcaccgcctacctgcagtggagcagcctgaaggccagcgacaccgccatgtactactgcgccagatggggcacctactacgacatcctgaccggctacttcaactggttcgacccctggggccagggcaccctggtgaccgtgagcagc

SEQ ID NO: 30982 - RNA, 321 nt, synthetic construct
  misc_feature 1..321: note = derived and/or modified sequence opt4 from HuMab-159_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtactacatctacccctggaccttcggccagggcaccaaggtggagatcaag

SEQ ID NO: 30983 - RNA, 363 nt, synthetic construct
  misc_feature 1..363: note = derived and/or modified sequence opt4 from HuMab-160_HeavyChain_VDJ-Region
  source 1..363: mol_type = other RNA
caggtgcagctggtggagagcggcggcggcgtggtgcagcccggcagaagcctgagactgagctgcgccgccagcggcttcaccttcagcagccacgccatgcactgggtgagacaggcccccggcaagggcctggagtgggtggccgccatcagctacgacggcagcaacaagtactacgccgacagcgtgaagggcagattcaccatcagcagagacaacagcaagaacaccatgtacctgcagatgaacagcctgagagccgaggacaccgccatgtgctactgcgccagaggcagcatcaccggcagcaccggcgtgttcgactactggggccagggcaccctggtgaccgtgagcagc

SEQ ID NO: 30984 - RNA, 321 nt, synthetic construct
  misc_feature 1..321: note = derived and/or modified sequence opt4 from HuMab-160_LightChain_VJ-Region
  source 1..321: mol_type = other RNA
gacatccagatgacccagagccccagcagcctgagcgccagcgtgggcgacagagtgaccatcacctgcagagccagccaggacatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctaccccatcaccttcggccagggcaccagactggagatcaag

SEQ ID NO: 30985 - RNA, 372 nt, synthetic construct
  misc_feature 1..372: note = derived and/or modified sequence opt4 from HuMab-162_HeavyChain_VDJ-Region
  source 1..372: mol_type = other RNA
gaggtgcagctgtgggagagcggcggcggcagcgtgcagcccggcggcagcctgagactgagctgcgccgccagcggcttcaccttcagcagctacggcatgagctgggtgagacaggcccccggcaagggcctggagtgggtgagcggcatcagcggcagcggctacagcacctactacgccgacagcgtgaagggcagattcaccatcagcagagacaacagcaagaacaccctgtacctgcagatgaacagcctgagagccgaggacaccgccgtgtactactgcgccaagggctactaccacggcagcggcagctactacaccagcttcgactactggggccagggcaccctggtgaccgtgagcagc

SEQ ID NO: 30986 - RNA, 321 nt, synthetic construct
  misc_feature 1..321: note = derived and/or modified sequence opt4 from HuMab-162_LightChain_VJ-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctaccccctgaccttcggcggcggcaccaaggtggagatcaag

SEQ ID NO: 30987 - RNA, 366 nt, synthetic construct
  misc_feature 1..366: note = derived and/or modified sequence opt4 from HuMab-163_HeavyChain_VDJ-Region
  source 1..366: mol_type = other RNA
gaggtgcagctggtgcagagcggcgccgaggtgaagaagcccggcgagagcctgaagatcagctgccagggcagcggctacagattcatcagctactggatcggctgggtgagacagatgcccggcaagggcctggagtggatgggcagaatctaccccggcgacagcgacaccagatacagccccagcttccagggccaggtgaccatcagcgtggacaagagcatcagcaccgcctacctgcagtggagcagcctgaaggccagcgacaccgccatgtactactgcgccagacagagaggcgactactactacttcaacggcctggacgtgtggggccagggcaccaccgtgaccgtgagcagc

SEQ ID NO: 30988 - RNA, 321 nt, synthetic construct
  misc_feature 1..321: note = derived and/or modified sequence opt4 from HuMab-163_LightChain_VJ-Region
  source 1..321: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcctgaccttcggcggcggcaccaaggtggagatcaag

SEQ ID NO: 30989 - RNA, 363 nt, synthetic construct
  misc_feature 1..363: note = derived and/or modified sequence opt4 from HuMab-166_HeavyChain_VDJ-Region
  source 1..363: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacgagtactacgccgacagcgtgaagggcagattcaccatcagcagagacaacagcaagaacaccctgtacctgcagatgaacagcctgagagccgaggacaccgccgtgtactactgcgccagaggcagcatcatcggcagcaccggcgtgttcgactactggggccagggcaccctggtgaccgtgagcagc

SEQ ID NO: 30990 - RNA, 321 nt, synthetic construct
  misc_feature 1..321: note = derived and/or modified sequence opt4 from HuMab-166_LightChain_VJ-Region
  source 1..321: mol_type = other RNA
gacatccagatgacccagagccccagcagcctgagcgccagcgtgggcgacagagtgaccatcacctgcagagccagccagggcatcagcaactggctggcctggtaccagcagaagcccgagaaggcccccaagagcctgatctacgacgccagcagcctgcagagcggcgtgcccagcagattcagcggcagcggcagcggcaccgacttcaccctgaccatcagcagcctgcagcccgaggacttcgccacctactactgccagcagtacaacagctaccccatcaccttcggccagggcaccagactggagatcaag

SEQ ID NO: 30991 - RNA, 363 nt, synthetic construct
  misc_feature 1..363: note = derived and/or modified sequence opt4 from HuMab-167_HeavyChain_VDJ-Region
  source 1..363: mol_type = other RNA
caggtgcagctggtggagagcggcggcggcgtggtgcagcccggcagaagcctgagactgagctgcgccgccagcggcttcaccttcagcagctacgccatccactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccagaggcagcatcaccggcagcaccggcgtgttcgactactggggccagggcaccctggtgaccgtgagcagc

SEQ ID NO: 30992 - RNA, 363 nt, synthetic construct
  misc_feature 1..363: note = derived and/or modified sequence opt4 from HuMab-169_HeavyChain_VDJ-Region
  source 1..363: mol_type = other RNA
caggtgcagctggtgcagagcggcgccgaggtgaagaagcccggcgccagcgtgaaggtgagctgcaaggccagcggctacaccttcaccaactacggcatcagctgggtgagacaggcccccggccagggcctggagtggatgggctggctgagcgcctacagcggcaacaccatctacgcccagaagctgcagggcagagtgaccatgaccaccgacaccagcaccaccaccgcctacatggagctgagaagcctgagaagcgacgacaccgccgtgtactactgcgccagagacagaatcgtggtgagacccgactacttcgactactggggccagggcaccctggtgaccgtgagcagc

SEQ ID NO: 30993 - RNA, 321 nt, synthetic construct
  misc_feature 1..321: note = derived and/or modified sequence opt4 from HuMab-169_LightChain_VJ-Region
  source 1..321: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccagaaccttcggccagggcaccaaggtggagatcaag

SEQ ID NO: 30994 - RNA, 366 nt, synthetic construct
  misc_feature 1..366: note = derived and/or modified sequence opt4 from HuMab-7D8_HeavyChain_VH-Region
  source 1..366: mol_type = other RNA
gaggtgcagctggtggagagcggcggcggcctggtgcagcccgacagaagcctgagactgagctgcgccgccagcggcttcaccttccacgactacgccatgcactgggtgagacaggcccccggcaagggcctggagtgggtgagcaccatcagctggaacagcggcaccatcggctacgccgacagcgtgaagggcagattcaccatcagcagagacaacgccaagaacagcctgtacctgcagatgaacagcctgagagccgaggacaccgccctgtactactgcgccaaggacatccagtacggcaactactactacggcatggacgtgtggggccagggcaccaccgtgaccgtgagcagc

SEQ ID NO: 30995 - RNA, 366 nt, synthetic construct; identical to SEQ ID NO: 30994
  misc_feature 1..366: note = derived and/or modified sequence opt4 from HuMab-7D8_HeavyChain_V-Region
  source 1..366: mol_type = other RNA

SEQ ID NO: 30996 - RNA, 321 nt, synthetic construct
  misc_feature 1..321: note = derived and/or modified sequence opt4 from HuMab-7D8_LightChain_VL-Region
  source 1..321: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccatcaccttcggccagggcaccagactggagatcaag

SEQ ID NO: 30997 - RNA, 321 nt, synthetic construct; identical to SEQ ID NO: 30996
  misc_feature 1..321: note = derived and/or modified sequence opt4 from HuMab-7D8_LightChain_V-Region
  source 1..321: mol_type = other RNA

SEQ ID NO: 30998 - RNA, 324 nt, synthetic construct
  misc_feature 1..324: note = derived and/or modified sequence opt4 from huMAb-anti-MSP10.1_LightChain_VJ-Region
  source 1..324: mol_type = other RNA
gagatcgtgctgacccagagccccgacatcctgagcctgagccccggcgagagagccaccctgagctgcagagccagccaggccctgaccgccaagtacctggcctggtaccagcagaagcccggccaggtgcccagactgctgatctacggcagcagcaccagagccaccggcatccccgacagattcagaggcagcggcagcggcaccgacttcaccctgaccatcagcagactggagcccgccgacagcgccgtgtactactgccagcagtacgaggacagcccctggaccttcggccagggcaccaagctggagatcaag

SEQ ID NO: 30999 - RNA, 324 nt, synthetic construct
  misc_feature 1..324: note = derived and/or modified sequence opt4 from huMAb-anti-MSP10.2_LightChain_VJ-Region
  source 1..324: mol_type = other RNA
gagatcgtgctgacccagagccccgacaccctgagcctgagccccggcgagaccgccaccctgagctgcagagccagccagaccgtgagaagaaacagcctggcctggtaccagcagaagcccggccaggcccccagactgctgatctacggcgccagcgacagagccaccggcatccccgacagattcagcggcagcggcttcggcaccgacttcaccctgaccgtgagcggcctggagcccgaggacttcgccgtgtactactgccagcagtacggcaccagccccagaaccttcggccagggcaccaagctggagatcaag

SEQ ID NO: 31000 - RNA, 324 nt, synthetic construct
  misc_feature 1..324: note = derived and/or modified sequence opt4 from HUMAB-Clone_18_VJ-Region
  source 1..324: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaagagagccaccggcatccccgccagattcagcggcagcggcagcggcaccgacttcaccctgaccatcagcagcctggagcccgaggacttcgccgtgtactactgccagcagagaagcaagtggcccccctggaccttcggccagggcaccaaggtggagagcaag

SEQ ID NO: 31001 - RNA, 324 nt, synthetic construct
  misc_feature 1..324: note = derived and/or modified sequence opt4 from HUMAB-Clone_22_VJ-Region
  source 1..324: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaagtggcccccctggaccttcggccagggcaccaaggtggagatcaag

SEQ ID NO: 31002 - RNA, 432 nt, synthetic construct
  misc_feature 1..432: note = derived and/or modified sequence opt4 from HuMab-L612_Chain_VDJ-Region_Precursor
  source 1..432: mol_type = other RNA
atggagttcggcctgacctggctgttcctggtggccaacctgaagggcgtgcagtgcgaggtgcagctgctggacagcggcggcggcctggtgcagcccggcggctgcctgagactgagctgcgccgccagcggcttcaccttcagcagctgcgccatgagctgggtgagacaggcccccggcaagggcctggagtgggtgagcgccatcagcggcagcggcggcagcacctactacgccgacagcgtgaagggcagattcaccatcagcagagacaagagcaagaacaccctgtacctgcagatgaacagcctgagagccgaggacaccgccgtgtactactgcgccaagggcggcaacgacatcctgaccggctactacgcctggggccagggcaccctggtgaccgtgagcagcggcagcgccagcgcc

SEQ ID NO: 31003 - RNA, 321 nt, synthetic construct
  misc_feature 1..321: note = derived and/or modified sequence opt4 from HuMab_LC5002-002_LightChain_V-Region
  source 1..321: mol_type = other RNA
gacatccagatgacccagagccccagcagcctgagcgccagcgtgggcgacagagtgaccatcacctgcagagccagccagggcatcagcagatgggtggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccctggaccttcggccagggcaccaaggtggagatcaag

SEQ ID NO: 31004 - RNA, 357 nt, synthetic construct
  misc_feature 1..357: note = derived and/or modified sequence opt4 from HuMab_LC5002-002_gamma1-Chain_V-Region
  source 1..357: mol_type = other RNA
gaggtgcagctgctggagagcggcggcggcctggtgcagcccggcggcagcctgagactgagctgcgccgccagcggcttcaccttcaacatctacgccatgaactgggtgagacaggcccccggcaagggcctggagtgggtgagcgtgatcagcggcagaggcatcaccacctactacgccgacagcgtgaagggcagattcaccatcagcagagacaacagcaagaacaccctgtacctgcagatgaacagcctgagagccgacgacaccgccgtgtactactgcgccaagggcagcagcagctggaccgacttcgactactggggccagggcaccctggtgaccgtgagcagc

SEQ ID NO: 31005 - RNA, 321 nt, synthetic construct
  misc_feature 1..321: note = derived and/or modified sequence opt4 from HuMab_LC5002-003_LightChain_V-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccctggaccttcggccagggcaccaaggtggagatcaag

SEQ ID NO: 31006 - RNA, 357 nt, synthetic construct
  misc_feature 1..357: note = derived and/or modified sequence opt4 from HuMab_LC5002-003_gamma1-Chain_V-Region
  source 1..357: mol_type = other RNA
gaggtgcagctgctggagagcggcggcgacctgatccagcccggcggcagcctgagactgagctgcgccgccagcggcttcaccttcaacatctacgccatgaactgggtgagacaggcccccggcaagggcctggagtgggtgagcgtgatcagcggcagaggcatcaccacctactacgccgacagcgtgaagggcagattcaccatcagcagagacaacagcaagaacaccctgtacctgcagatggacagcctgagagccgaggacaccgccgtgtactactgcgccaagggcagcagctactggaccgacttcgactactggggccagggcaccctggtgaccgtgagcagc

SEQ ID NO: 31007 - RNA, 321 nt, synthetic construct
  misc_feature 1..321: note = derived and/or modified sequence opt4 from HuMab_LC5002-005_LightChain_V-Region
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagccacccccccaccttcggccagggcaccaagctggagatcaag

SEQ ID NO: 31008 - RNA, 354 nt, synthetic construct
  misc_feature 1..354: note = derived and/or modified sequence opt4 from HuMab_LC5002-005_gamma1-Chain_V-Region
  source 1..354: mol_type = other RNA
gaggtgcaggtgctggacagcggcggcggcctggtgcagcccggcggcagcctgagactgagctgcaccgccagcggcttcaccttcagactgtacaccatgagctgggtgagacagacccccggcagaggcctggagtgggtgagcggcatcagcggcagcggcctgagcacctacttcgccgacagcgtgaagggcagattcaccatcagcagagacaacagcaagaacaccgtgtacctgcagatgaacagcctgagagccgaggacaccgccgtgtactactgcgccaaggagggcgactggatctacttcgacagctggggccagggcaccctggtgatcgtgagcagc

SEQ ID NO: 31009 - RNA, 321 nt, synthetic construct
  misc_feature 1..321: note = derived and/or modified sequence opt4 from HuMab_LC5002-007_LightChain_V-Region
  source 1..321: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccatcggcatccccgacagattcagcggcagcggcagcggcaccgacttcaccctgaccatcagcagactggagcccgaggacttcgccgtgtactactgccagcactacggcagcagcctgaccttcggcggcggcaccaaggtggagatcaag

SEQ ID NO: 31010 - RNA, 369 nt, synthetic construct
  misc_feature 1..369: note = derived and/or modified sequence opt4 from HuMab_LC5002-007__gamma1-Chain_V-Region
  source 1..369: mol_type = other RNA
caggtgcagctggtgcagagcggcgccgaggtgaagaagcccggcagcagcgtgaaggtgagctgcaaggtgagcggcggcaccttcagcagctacgccttcagctgggtgagacaggcccccggccagggcctggagtggatgggcagaatcatccccatcctgggcagaaccaactacgcccagaagttccagggcagagtgaccatcaccgccgacaagagcaccagcaccgcctacatggaggtgagcagcctgagaagcgaggacaccgccgtgtactactgcgccagagagggcgagaccctggactacttctactacggcatggacgtgtggggccagggcaccaccgtgaccgtgagcagc

SEQ ID NO: 31011 - RNA, 357 nt, synthetic construct
  misc_feature 1..357: note = derived and/or modified sequence opt4 from HuMab_LC5002-018_gamma1-Chain_V-Region
  source 1..357: mol_type = other RNA
gaggtgcagctgctggagagcggcggcggcctggtgcagcccggcggcagcctgagactgagctgcgccgccagcggcttcaccttcaacatctacgccatgaactgggtgagacaggcccccggcaagggcctggagtgggtgagcgtgatcagcggcagcggcgtgaccacctactacgccgacagcgtgaagggcagattcaccatcagcagagacaacagcaagaacaccctgtacctgcagatgaacagcctgagagccgaggacaccgccgtgtactactgcgccaagggcagcagctggtacgtggacttcgactactggggccagggcaccctggtgaccgtgagcagc

SEQ ID NO: 31012 - RNA, 1347 nt, synthetic construct
  misc_feature 1..1347: note = derived and/or modified sequence opt4 from Ibalizumab_HeavyChain1
  source 1..1347: mol_type = other RNA
caggtgcagctgcagcagagcggccccgaggtggtgaagcccggcgccagcgtgaagatgagctgcaaggccagcggctacaccttcaccagctacgtgatccactgggtgagacagaagcccggccagggcctggactggatcggctacatcaacccctacaacgacggcaccgactacgacgagaagttcaagggcaaggccaccctgaccagcgacaccagcaccagcaccgcctacatggagctgagcagcctgagaagcgaggacaccgccgtgtactactgcgccagagagaaggacaactacgccaccggcgcctggttcgcctactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31013 - RNA, 657 nt, synthetic construct
  misc_feature 1..657: note = derived and/or modified sequence opt4 from Ibalizumab_LightChain1
  source 1..657: mol_type = other RNA
gacatcgtgatgacccagagccccgacagcctggccgtgagcctgggcgagagagtgaccatgaactgcaagagcagccagagcctgctgtacagcaccaaccagaagaactacctggcctggtaccagcagaagcccggccagagccccaagctgctgatctactgggccagcaccagagagagcggcgtgcccgacagattcagcggcagcggcagcggcaccgacttcaccctgaccatcagcagcgtgcaggccgaggacgtggccgtgtactactgccagcagtactacagctacagaaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31014 - RNA, 1329 nt, synthetic construct
  misc_feature 1..1329: note = derived and/or modified sequence opt4 from Ibritumomab_tiuxetan_HeavyChain
  source 1..1329: mol_type = other RNA
caggcctacctgcagcagagcggcgccgagctggtgagacccggcgccagcgtgaagatgagctgcaaggccagcggctacaccttcaccagctacaacatgcactgggtgaagcagacccccagacagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagagtggtgtactacagcaacagctactggtacttcgacgtgtggggcaccggcaccaccgtgaccgtgagcgcccccagcgtgtaccccctggcccccgtgtgcggcgacaccaccggcagcagcgtgaccctgggctgcctggtgaagggctacttccccgagcccgtgaccctgacctggaacagcggcagcctgagcagcggcgtgcacaccttccccgccgtgctgcagagcgacctgtacaccctgagcagcagcgtgaccgtgaccagcagcacctggcccagccagagcatcacctgcaacgtggcccaccccgccagcagcaccaaggtggacaagaagatcgagcccagaggccccaccatcaagccctgccccccctgcaagtgccccgcccccaacctgctgggcggccccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccacagagaggactacaacagcaccctgagagtggtgagcgccctgcccatccagcaccaggactggatgagcggcaaggagttcaagtgcaaggtgaacaacaaggacctgcccgcccccatcgagagaaccatcagcaagcccaagggcagcgtgagagccccccaggtgtacgtgctgcccccccccgaggaggagatgaccaagaagcaggtgaccctgacctgcatggtgaccgacttcatgcccgaggacatctacgtggagtggaccaacaacggcaagaccgagctgaactacaagaacaccgagcccgtgctggacagcgacggcagctacttcatgtacagcaagctgagagtggagaagaagaactgggtggagagaaacagctacagctgcagcgtggtgcacgagggcctgcacaaccaccacaccaccaagagcttcagcaga

SEQ ID NO: 31015 - RNA, 627 nt, synthetic construct
  misc_feature 1..627: note = derived and/or modified sequence opt4 from Ibritumomab_tiuxetan_LightChain
  source 1..627: mol_type = other RNA
cagatcgtgctgagccagagccccgccatcctgagcgccagccccggcgagaaggtgaccatgacctgcagagccagcagcagcgtgagctacatgcactggtaccagcagaagcccggcagcagccccaagccctggatctacgcccccagcaacctggccagcggcgtgcccgccagattcagcggcagcggcagcggcaccagctacagcctgaccatcagcagagtggaggccgaggacgccgccacctactactgccagcagtggagcttcaacccccccaccttcggcgccggcaccaagctggagctgaagagagccgacgccgcccccaccgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaac

SEQ ID NO: 31016 - RNA, 1368 nt, synthetic construct
  misc_feature 1..1368: note = derived and/or modified sequence opt4 from Icrucumab_HeavyChain1
  source 1..1368: mol_type = other RNA
caggcccaggtggtggagagcggcggcggcgtggtgcagagcggcagaagcctgagactgagctgcgccgccagcggcttcgccttcagcagctacggcatgcactgggtgagacaggcccccggcaagggcctggagtgggtggccgtgatctggtacgacggcagcaacaagtactacgccgacagcgtgagaggcagattcaccatcagcagagacaacagcgagaacaccctgtacctgcagatgaacagcctgagagccgaggacaccgccgtgtactactgcgccagagaccactacggcagcggcgtgcaccactacttctactacggcctggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31017 - RNA, 645 nt, synthetic construct
  misc_feature 1..645: note = derived and/or modified sequence opt4 from Icrucumab_LightChain1
  source 1..645: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31018 - RNA, 675 nt, synthetic construct
  misc_feature 1..675: note = derived and/or modified sequence opt4 from Idarucizumab_HeavyChain1
  source 1..675: mol_type = other RNA
caggtgcagctgcaggagagcggccccggcctggtgaagcccagcgagaccctgagcctgacctgcaccgtgagcggcttcagcctgaccagctacatcgtggactggatcagacagccccccggcaagggcctggagtggatcggcgtgatctgggccggcggcagcaccggctacaacagcgccctgagaagcagagtgagcatcaccaaggacaccagcaagaaccagttcagcctgaagctgagcagcgtgaccgccgccgacaccgccgtgtactactgcgccagcgccgcctactacagctactacaactacgacggcttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31019 - RNA, 657 nt, synthetic construct
  misc_feature 1..657: note = derived and/or modified sequence opt4 from Idarucizumab_LightChain1
  source 1..657: mol_type = other RNA
gacgtggtgatgacccagagccccctgagcctgcccgtgaccctgggccagcccgccagcatcagctgcaagagcagccagagcctgctgtacaccgacggcaagacctacctgtactggttcctgcagagacccggccagagccccagaagactgatctacctggtgagcaagctggacagcggcgtgcccgacagattcagcggcagcggcagcggcaccgacttcaccctgaagatcagcagagtggaggccgaggacgtgggcgtgtactactgcctgcagagcacccacttcccccacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31020 - RNA, 1332 nt, synthetic construct
  misc_feature 1..1332: note = derived and/or modified sequence opt4 from Igatuzuab_HeavyChain1
  source 1..1332: mol_type = other RNA
caggtgcagctggtgcagagcggcgccgaggtgaagaagcccggcagcagcgtgaaggtgagctgcaaggccagcggcttcaccttcaccgactacaagatccactgggtgagacaggcccccggccagggcctggagtggggctacttcaaccccaacagcggctacagcacctacgcccagaagttccagggcagagtgaccatcaccgccgacaagagcaccagcaccgcctacgagctgagcagcctgagaagcgaggacaccgccgtgtactactgcgccagactgagccccggcggctactacgtggacgcctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 31021 - RNA, 636 nt, synthetic construct
  misc_feature 1..636: note = derived and/or modified sequence opt4 from Igatuzuab_LightChain1
  source 1..636: mol_type = other RNA
gacatccagacccagagccccagcagcctgagcgccagcgtgggcgacagagtgaccatcacctgcagagccagccagggcatcaacaactacctgaactggtaccagcagaagcccggcaaggcccccaagagactgatctacaacaccaacaacctgcagaccggcgtgcccagcagattcagcggcagcggcagcggcaccgagttcaccctgaccatcagcagcctgcagcccgaggacttcgccacctactactgcctgcagcacaacagcttccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31022 - RNA, 357 nt, synthetic construct
  misc_feature 1..357: note = derived and/or modified sequence opt4 from IGF-IR_HUMAB-1A_HeavyChain
  source 1..357: mol_type = other RNA
gaggtgcagctggtgcagagcggcggcggcctggtgcaccccggcggcagcctgagactgagctgcgccggcagcggcttcaccttcagaaactacgccatgtactgggtgagacaggcccccggcaagggcctggagtgggtgagcgccatcggcagcggcggcggcacctactacgccgacagcgtgaagggcagattcaccatcagcagagacaacgccaagaacagcctgtacctgcagatgaacagcctgagagccgaggacatggccgtgtactactgcgccagagcccccaactggggcagcgacgccttcgacatctggggccagggcaccatggtgaccgtgagcagc

SEQ ID NO: 31023 - RNA, 357 nt, synthetic construct
  misc_feature 1..357: note = derived and/or modified sequence opt4 from IGF-IR_HUMAB-23_HeavyChain
  source 1..357: mol_type = other RNA
gaggtgcagctggtgcagagcggcggcggcctggtgcaccccggcggcagcctgagactgagctgcgccggcagcggcttcaccttcagcaactacgccatgtactgggtgagacaggcccccggcaagggcctggagtgggtgagcgccatcggcagcggcggcggcacctactacgccgacagcgtgaagggcagattcaccatcagcagagacaacgccaagaacagcctgtacctgcagatgaacagcctgagagccgaggacatggccgtgtaccactgcgccagagcccccaactggggcagcgaggccttcgacatctggggccagggcaccatggtgaccgtgagcagc

SEQ ID NO: 31024 - RNA, 321 nt, synthetic construct; identical to SEQ ID NO: 30920
  misc_feature 1..321: note = derived and/or modified sequence opt4 from IGF-IR_HUMAB-23_LightChain
  source 1..321: mol_type = other RNA

SEQ ID NO: 31025 - RNA, 357 nt, synthetic construct
  misc_feature 1..357: note = derived and/or modified sequence opt4 from IGF-IR_HUMAB-8_HeavyChain
  source 1..357: mol_type = other RNA
gaggtgcagctggtgcagagcggcggcggcctggtgcaccccggcggcagcctgagactgagctgcgccggcagcggcttcaccttcagaagctacgccatgtactgggtgagacaggcccccggcaagggcctggagtgggtgagcgccatcggcagcggcggcggcacctactacgccgacagcgtgaagggcagattcaccatcagcagagacaacgccaagaacagcctgtacctgcagatgaacagcctgagagccgaggacatggccgtgtactactgcgccagagcccccaactggggcagcgacgccttcgacatctggggccagggcaccatggtgaccgtgagcagc

SEQ ID NO: 31026 - RNA, 321 nt, synthetic construct
  misc_feature 1..321: note = derived and/or modified sequence opt4 from IGF-IR_HUMAB-8_LightChain
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccccccaccttcggccccggcaccaaggtggacatcaag

SEQ ID NO: 31027 - RNA, 708 nt, synthetic construct
  misc_feature 1..708: note = derived and/or modified sequence opt4 from ImAb1_LightChain
  source 1..708: mol_type = other RNA
atggacatgagagcccccgcccagttcttcggcatcctgctgctgtggttccccggcatcagatgcgacatcaagatgacccagagccccagcagcatgtacgccagcctgggcgagagagtgaccatcacctgcaaggccagccaggacatcaagagctacctgagctggtaccagcagaagccctggaagagccccaagatcctgatctactacgccaccagcctggccgacggcgtgcccagcagaatcagcggcagcggcagcggccaggactacagcctgaccatcagcagcctggagagcgacgacaccgccacctactactgcctgcagcacggcgagagcccctacaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 31028 - RNA, 681 nt, synthetic construct
  misc_feature 1..681: note = derived and/or modified sequence opt4 from ImAb1_gamma1-Chain
  source 1..681: mol_type = other RNA
atgaacttcggcttcagcctgatcttcctggtgctggtgctgaagggcgtgcagtgcgaggtgaagctggtggagagcggcggcggcctggtgaagcccggcggcagcctgaagctgagctgcgccgccagcggcttcaccttcagcaactacgccatgagctgggtgagacagacccccgagaagagactggagtgggtggccagcatcagcagcgacggcgacacctacttccccgacaacgtgaagggcagattcaccatcagcagagagaacgccggcaacatcctgttcctgcagatgagcagcctgagaagcgaggacaccgccatgtactactgcgccagaggcttcatgatcaccttctggggccagggcaccctggtgaccgtgagcgccgccaagaccaccccccccagcgtgtaccccctggcccccggctgcggcgacaccaccggcagcagcgtgaccctgggctgcctggtgaagggctacttccccgagagcgtgaccgtgacctggaacagcggcagcctgagcagcagcgtgcacaccttccccgccctgctgcagagcggcctgtacaccatgagcagcagcgtgaccgtgcccagcagcacctggcccagccagaccgtgacctgcagcgtggcccaccccgccagcagcaccaccgtggac

SEQ ID NO: 31029 - RNA, 1344 nt, synthetic construct
  misc_feature 1..1344: note = derived and/or modified sequence opt4 from Imalumab_HeavyChain1
  source 1..1344: mol_type = other RNA
gaggtgcagctgctggagagcggcggcggcctggtgcagcccggcggcagcctgagactgagctgcgccgccagcggcttcaccttcagcatctacagcatgaactgggtgagacaggcccccggcaagggcctggagtgggtgagcagcatcggcagcagcggcggcaccacctactacgccgacagcgtgaagggcagattcaccatcagcagagacaacagcaagaacaccctgtacctgcagatgaacagcctgagagccgaggacaccgccgtgtactactgcgccggcagccagtggctgtacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31030 - RNA, 642 nt, synthetic construct
  misc_feature 1..642: note = derived and/or modified sequence opt4 from Imalumab_LightChain1
  source 1..642: mol_type = other RNA
gacatccagatgacccagagccccagcagcctgagcgccagcgtgggcgacagagtgaccatcacctgcagaagcagccagagaatcatgacctacctgaactggtaccagcagaagcccggcaaggcccccaagctgctgatcttcgtggccagccacagccagagcggcgtgcccagcagattcagaggcagcggcagcgagaccgacttcaccctgaccatcagcggcctgcagcccgaggacagcgccacctactactgccagcagagcttctggacccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31031 - RNA, 1347 nt, synthetic construct
  misc_feature 1..1347: note = derived and/or modified sequence opt4 from Imgatuzumab_HeavyChain1
  source 1..1347: mol_type = other RNA
caggtgcagctggtgcagagcggcgccgaggtgaagaagcccggcagcagcgtgaaggtgagctgcaaggccagcggcttcaccttcaccgactacaagatccactgggtgagacaggcccccggccagggcctggagtggatgggctacttcaaccccaacagcggctacagcacctacgcccagaagttccagggcagagtgaccatcaccgccgacaagagcaccagcaccgcctacatggagctgagcagcctgagaagcgaggacaccgccgtgtactactgcgccagactgagccccggcggctactacgtgatggacgcctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31032 - RNA, 639 nt, synthetic construct
  misc_feature 1..639: note = derived and/or modified sequence opt4 from Imgatuzumab_LightChain1
  source 1..639: mol_type = other RNA
gacatccagatgacccagagccccagcagcctgagcgccagcgtgggcgacagagtgaccatcacctgcagagccagccagggcatcaacaactacctgaactggtaccagcagaagcccggcaaggcccccaagagactgatctacaacaccaacaacctgcagaccggcgtgcccagcagattcagcggcagcggcagcggcaccgagttcaccctgaccatcagcagcctgcagcccgaggacttcgccacctactactgcctgcagcacaacagcttccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31033 - RNA, 1353 nt, synthetic construct
  misc_feature 1..1353: note = derived and/or modified sequence opt4 from Inclacumab_HeavyChain1
  source 1..1353: mol_type = other RNA
gaggtgcagctggtggagagcggcggcggcctggtgagacccggcggcagcctgagactgagctgcgccgccagcggcttcaccttcagcaactacgacatgcactgggtgagacaggccaccggcaagggcctggagtgggtgagcgccatcaccgccgccggcgacatctactaccccggcagcgtgaagggcagattcaccatcagcagagagaacgccaagaacagcctgtacctgcagatgaacagcctgagagccggcgacaccgccgtgtactactgcgccagaggcagatacagcggcagcggcagctactacaacgactggttcgacccctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcgagggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31034 - RNA, 642 nt, synthetic construct
  misc_feature 1..642: note = derived and/or modified sequence opt4 from Inclacumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31035 - RNA, 1347 nt, synthetic construct
  misc_feature 1..1347: note = derived and/or modified sequence opt4 from Indatuximab_ravtansine_HeavyChain1
  source 1..1347: mol_type = other RNA
caggtgcagctgcagcagagcggcagcgagctgatgatgcccggcgccagcgtgaagatcagctgcaaggccaccggctacaccttcagcaactactggatcgagtgggtgaagcagagacccggccacggcctggagtggatcggcgagatcctgcccggcaccggcagaaccatctacaacgagaagttcaagggcaaggccaccttcaccgccgacatcagcagcaacaccgtgcagatgcagctgagcagcctgaccagcgaggacagcgccgtgtactactgcgccagaagagactactacggcaacttctactacgccatggactactggggccagggcaccagcgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31036 - RNA, 642 nt, synthetic construct
  misc_feature 1..642: note = derived and/or modified sequence opt4 from Indatuximab_ravtansine_LightChain1
  source 1..642: mol_type = other RNA
gacatccagatgacccagagcaccagcagcctgagcgccagcctgggcgacagagtgaccatcagctgcagcgccagccagggcatcaacaactacctgaactggtaccagcagaagcccgacggcaccgtggagctgctgatctactacaccagcaccctgcagagcggcgtgcccagcagattcagcggcagcggcagcggcaccgactacagcctgaccatcagcaacctggagcccgaggacatcggcacctactactgccagcagtacagcaagctgcccagaaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31037 - RNA, 1347 nt, synthetic construct
  misc_feature 1..1347: note = derived and/or modified sequence opt4 from Indusatumab_vedotin_HeavyChain1
  source 1..1347: mol_type = other RNA
caggtgcagctgcagcagtggggcgccggcctgctgaagcccagcgagaccctgagcctgacctgcgccgtgttcggcggcagcttcagcggctactactggagctggatcagacagccccccggcaagggcctggagtggatcggcgagatcaaccacagaggcaacaccaacgacaaccccagcctgaagagcagagtgaccatcagcgtggacaccagcaagaaccagttcgccctgaagctgagcagcgtgaccgccgccgacaccgccgtgtactactgcgccagagagagaggctacacctacggcaacttcgaccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31038 - RNA, 642 nt, synthetic construct
  misc_feature 1..642: note = derived and/or modified sequence opt4 from Indusatumab_vedotin_LightChain1
  source 1..642: mol_type = other RNA
gagatcgtgatgacccagagccccgccaccctgagcgtgagccccggcgagagagccaccctgagctgcagagccagccagagcgtgagcagaaacctggcctggtaccagcagaagcccggccaggcccccagactgctgatctacggcgccagcaccagagccaccggcatccccgccagattcagcggcagcggcagcggcaccgagttcaccctgaccatcggcagcctgcagagcgaggacttcgccgtgtactactgccagcagtacaagacctggcccagaaccttcggccagggcaccaacgtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31039 - RNA, 1353 nt, synthetic construct
  misc_feature 1..1353: note = derived and/or modified sequence opt4 from Inebilizumab_HeavyChain1
  source 1..1353: mol_type = other RNA
gaggtgcagctggtggagagcggcggcggcctggtgcagcccggcggcagcctgagactgagctgcgccgccagcggcttcaccttcagcagcagctggatgaactgggtgagacaggcccccggcaagggcctggagtgggtgggcagaatctaccccggcgacggcgacaccaactacaacgtgaagttcaagggcagattcaccatcagcagagacgacagcaagaacagcctgtacctgcagatgaacagcctgaagaccgaggacaccgccgtgtactactgcgccagaagcggcttcatcaccaccgtgagagacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31040 - RNA, 654 nt, synthetic construct
  misc_feature 1..654: note = derived and/or modified sequence opt4 from Inebilizumab_LightChain1
  source 1..654: mol_type = other RNA
gagatcgtgctgacccagagccccgacttccagagcgtgacccccaaggagaaggtgaccatcacctgcagagccagcgagagcgtggacaccttcggcatcagcttcatgaactggttccagcagaagcccgaccagagccccaagctgctgatccacgaggccagcaaccagggcagcggcgtgcccagcagattcagcggcagcggcagcggcaccgacttcaccctgaccatcaacagcctggaggccgaggacgccgccacctactactgccagcagagcaaggaggtgcccttcaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31041 - RNA, 90 nt, synthetic construct
  misc_feature 1..90: note = derived and/or modified sequence opt4 from Insulin_peglispro_Fragment1
  source 1..90: mol_type = other RNA
ttcgtgaaccagcacctgtgcggcagccacctggtggaggccctgtacctggtgtgcggcgagagaggcttcttctacaccaagcccacc

SEQ ID NO: 31042 - RNA, 63 nt, synthetic construct
  misc_feature 1..63: note = derived and/or modified sequence opt4 from Insulin_peglispro_Fragment2
  source 1..63: mol_type = other RNA
ggcatcgtggagcagtgctgcaccagcatctgcagcctgtaccagctggagaactactgcaac

SEQ ID NO: 31043 - RNA, 495 nt, synthetic construct
  misc_feature 1..495: note = derived and/or modified sequence opt4 from Interferon_beta-1b_chain1
  source 1..495: mol_type = other RNA
agctacaacctgctgggcttcctgcagagaagcagcaacttccagagccagaagctgctgtggcagctgaacggcagactggagtactgcctgaaggacagaatgaacttcgacatccccgaggagatcaagcagctgcagcagttccagaaggaggacgccgccctgaccatctacgagatgctgcagaacatcttcgccatcttcagacaggacagcagcagcaccggctggaacgagaccatcgtggagaacctgctggccaacgtgtaccaccagatcaaccacctgaagaccgtgctggaggagaagctggagaaggaggacttcaccagaggcaagctgatgagcagcctgcacctgaagagatactacggcagaatcctgcactacctgaaggccaaggagtacagccactgcgcctggaccatcgtgagagtggagatcctgagaaacttctacttcatcaacagactgaccggctacctgagaaac

SEQ ID NO: 31044 - RNA, 1347 nt, synthetic construct
  misc_feature 1..1347: note = derived and/or modified sequence opt4 from Intetumumab_HeavyChain1
  source 1..1347: mol_type = other RNA
caggtgcagctggtggagagcggcggcggcgtggtgcagcccggcagaagcagaagactgagctgcgccgccagcggcttcaccttcagcagatacaccatgcactgggtgagacaggcccccggcaagggcctggagtgggtggccgtgatcagcttcgacggcagcaacaagtactacgtggacagcgtgaagggcagattcaccatcagcagagacaacagcgagaacaccctgtacctgcaggtgaacatcctgagagccgaggacaccgccgtgtactactgcgccagagaggccagaggcagctacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31045 - RNA, 645 nt, synthetic construct
  misc_feature 1..645: note = derived and/or modified sequence opt4 from Intetumumab_LightChain1
  source 1..645: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31046 - RNA, 1347 nt, synthetic construct; identical to SEQ ID NO: 30904
  misc_feature 1..1347: note = derived and/or modified sequence opt4 from Iodine_(124I)_Girentuximab_HeavyChain1
  source 1..1347: mol_type = other RNA

SEQ ID NO: 31047 - RNA, 642 nt, synthetic construct; identical to SEQ ID NO: 30905
  misc_feature 1..642: note = derived and/or modified sequence opt4 from Iodine_(124I)_Girentuximab_LightChain1
  source 1..642: mol_type = other RNA

SEQ ID NO: 31048 - RNA, 1335 nt, synthetic construct
  misc_feature 1..1335: note = derived and/or modified sequence opt4 from Iodine_(131I)_derlotuxiab_biotin_HeavyChain1
  source 1..1335: mol_type = other RNA
caggtgcagctgaaggagagcggccccggcctggtggcccccagccagagcctgagcatcacctgcaccgtgagcggcttcagcctgaccgactacggcgtgagatggatcagacagccccccggcaagggcctggagtggctgggcgtgatctggggcggcggcagcacctactacaacagcgccctgaagagcagactgagcatcagcaaggacaacagcaagagccaggtgttcctgaagaacagcctgcagaccgacgacaccgcctactactgcgccaaggagaagagaagaggctactactacgccgactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 31049 - RNA, 639 nt, synthetic construct
  misc_feature 1..639: note = derived and/or modified sequence opt4 from Iodine_(131I)_derlotuxiab_biotin_LightChain1
  source 1..639: mol_type = other RNA
gagaacgtgctgacccagagccccgccatcagcgccagccccggcgagaaggtgaccacctgcagagccagcagcagcgtgagcagcagctacctgcactggtaccagcagaagagcggcgccagccccaagctgtggatctacagcaccagcaacctggccagcggcgtgcccgccagattcagcggcagcggcagcggcaccagctacagcctgaccatcagcagcgtggaggccgaggacgccgccacctactactgccagcagtacagcggctaccccctgaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31050 - RNA, 1350 nt, synthetic construct
  misc_feature 1..1350: note = derived and/or modified sequence opt4 from Iodine_(131I)_Derlotuximab_biotin_HeavyChain1
  source 1..1350: mol_type = other RNA
caggtgcagctgaaggagagcggccccggcctggtggcccccagccagagcctgagcatcacctgcaccgtgagcggcttcagcctgaccgactacggcgtgagatggatcagacagccccccggcaagggcctggagtggctgggcgtgatctggggcggcggcagcacctactacaacagcgccctgaagagcagactgagcatcagcaaggacaacagcaagagccaggtgttcctgaagatgaacagcctgcagaccgacgacaccgccatgtactactgcgccaaggagaagagaagaggctactactacgccatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31051 - RNA, 645 nt, synthetic construct
  misc_feature 1..645: note = derived and/or modified sequence opt4 from Iodine_(131I)_Derlotuximab_biotin_LightChain1
  source 1..645: mol_type = other RNA
gagaacgtgctgacccagagccccgccatcatgagcgccagccccggcgagaaggtgaccatgacctgcagagccagcagcagcgtgagcagcagctacctgcactggtaccagcagaagagcggcgccagccccaagctgtggatctacagcaccagcaacctggccagcggcgtgcccgccagattcagcggcagcggcagcggcaccagctacagcctgaccatcagcagcgtggaggccgaggacgccgccacctactactgccagcagtacagcggctaccccctgaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31052 - RNA, 1344 nt, synthetic construct
  misc_feature 1..1344: note = derived and/or modified sequence opt4 from Ipilimumab_HeavyChain
  source 1..1344: mol_type = other RNA
caggtgcagctggtggagagcggcggcggcgtggtgcagcccggcagaagcctgagactgagctgcgccgccagcggcttcaccttcagcagctacaccatgcactgggtgagacaggcccccggcaagggcctggagtgggtgaccttcatcagctacgacggcaacaacaagtactacgccgacagcgtgaagggcagattcaccatcagcagagacaacagcaagaacaccctgtacctgcagatgaacagcctgagagccgaggacaccgccatctactactgcgccagaaccggctggctgggccccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31053 - RNA, 645 nt, synthetic construct
  misc_feature 1..645: note = derived and/or modified sequence opt4 from Ipilimumab_LightChain
  source 1..645: mol_type = other RNA
gagatcgtgctgacccagagccccggcaccctgagcctgagccccggcgagagagccaccctgagctgcagagccagccagagcgtgggcagcagctacctggcctggtaccagcagaagcccggccaggcccccagactgctgatctacggcgccttcagcagagccaccggcatccccgacagattcagcggcagcggcagcggcaccgacttcaccctgaccatcagcagactggagcccgaggacttcgccgtgtactactgccagcagtacggcagcagcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31054 - RNA, 186 nt, synthetic construct
  misc_feature 1..186: note = derived and/or modified sequence opt4 from Iratumumab_HeavyChain1
  source 1..186: mol_type = other RNA
caggtgcagctgcagcagtggggcgccggcctgctgaagcccagcgagaccctgagcctgacctgcgccgtgtacggcggcagcttcagcgcctactactggagctggatcagacagccccccggcaagggcctggagtggatcggcgactactggggccagggcagcctggtgaccgtgagcagc

SEQ ID NO: 31055 - RNA, 321 nt, synthetic construct
  misc_feature 1..321: note = derived and/or modified sequence opt4 from Iratumumab_LightChain1
  source 1..321: mol_type = other RNA
gacatccagatgacccagagccccaccagcctgagcgccagcgtgggcgacagagtgaccatcacctgcagagccagccagggcatcagcagctggctgacctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacgacagctaccccatcaccttcggccagggcaccagactggagatcaag

SEQ ID NO: 31056 - RNA, 1350 nt, synthetic construct
  misc_feature 1..1350: note = derived and/or modified sequence opt4 from Isatuximab_HeavyChain1
  source 1..1350: mol_type = other RNA
caggtgcagctggtgcagagcggcgccgaggtggccaagcccggcaccagcgtgaagctgagctgcaaggccagcggctacaccttcaccgactactggatgcagtgggtgaagcagagacccggccagggcctggagtggatcggcaccatctaccccggcgacggcgacaccggctacgcccagaagttccagggcaaggccaccctgaccgccgacaagagcagcaagaccgtgtacatgcacctgagcagcctggccagcgaggacagcgccgtgtactactgcgccagaggcgactactacggcagcaacagcctggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31057 - RNA, 642 nt, synthetic construct
  misc_feature 1..642: note = derived and/or modified sequence opt4 from Isatuximab_LightChain1
  source 1..642: mol_type = other RNA
gacatcgtgatgacccagagccacctgagcatgagcaccagcctgggcgaccccgtgagcatcacctgcaaggccagccaggacgtgagcaccgtggtggcctggtaccagcagaagcccggccagagccccagaagactgatctacagcgccagctacagatacatcggcgtgcccgacagattcaccggcagcggcgccggcaccgacttcaccttcaccatcagcagcgtgcaggccgaggacctggccgtgtactactgccagcagcactacagccccccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31058 - RNA, 1347 nt, synthetic construct
  misc_feature 1..1347: note = derived and/or modified sequence opt4 from Itolizumab_HeavyChain1
  source 1..1347: mol_type = other RNA
gaggtgcagctggtggagagcggcggcggcctggtgaagcccggcggcagcctgaagctgagctgcgccgccagcggcttcaagttcagcagatacgccatgagctgggtgagacaggcccccggcaagagactggagtgggtggccaccatcagcagcggcggcagctacatctactaccccgacagcgtgaagggcagattcaccatcagcagagacaacgtgaagaacaccctgtacctgcagatgagcagcctgagaagcgaggacaccgccatgtactactgcgccagaagagactacgacctggactacttcgacagctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31059 - RNA, 642 nt, synthetic construct
  misc_feature 1..642: note = derived and/or modified sequence opt4 from Itolizumab_LightChain1
  source 1..642: mol_type = other RNA
gacatccagatgacccagagccccagcagcctgagcgccagcgtgggcgacagagtgaccatcacctgcaaggccagcagagacatcagaagctacctgacctggtaccagcagaagcccggcaaggcccccaagaccctgatctactacgccaccagcctggccgacggcgtgcccagcagattcagcggcagcggcagcggccaggactacagcctgaccatcagcagcctggagagcgacgacaccgccacctactactgcctgcagcacggcgagagccccttcaccctgggcagcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31060 - RNA, 1335 nt, synthetic construct
  misc_feature 1..1335: note = derived and/or modified sequence opt4 from Ixekizumab_HeavyChain1
  source 1..1335: mol_type = other RNA
caggtgcagctggtgcagagcggcgccgaggtgaagaagcccggcagcagcgtgaaggtgagctgcaaggccagcggctacagcttcaccgactaccacatccactgggtgagacaggcccccggccagggcctggagtggatgggcgtgatcaaccccatgtacggcaccaccgactacaaccagagattcaagggcagagtgaccatcaccgccgacgagagcaccagcaccgcctacatggagctgagcagcctgagaagcgaggacaccgccgtgtactactgcgccagatacgactacttcaccggcaccggcgtgtactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 31061 - RNA, 657 nt, synthetic construct
  misc_feature 1..657: note = derived and/or modified sequence opt4 from Ixekizumab_LightChain1
  source 1..657: mol_type = other RNA
gacatcgtgatgacccagacccccctgagcctgagcgtgacccccggccagcccgccagcatcagctgcagaagcagcagaagcctggtgcacagcagaggcaacacctacctgcactggtacctgcagaagcccggccagagcccccagctgctgatctacaaggtgagcaacagattcatcggcgtgcccgacagattcagcggcagcggcagcggcaccgacttcaccctgaagatcagcagagtggaggccgaggacgtgggcgtgtactactgcagccagagcacccacctgcccttcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31062 - RNA, 1347 nt, synthetic construct
  misc_feature 1..1347: note = derived and/or modified sequence opt4 from Labetuzumab_govitecan_HeavyChain1
  source 1..1347: mol_type = other RNA
gaggtgcagctggtggagagcggcggcggcgtggtgcagcccggcagaagcctgagactgagctgcagcgccagcggcttcgacttcaccacctactggatgagctgggtgagacaggcccccggcaagggcctggagtggatcggcgagatccaccccgacagcagcaccatcaactacgcccccagcctgaaggacagattcaccatcagcagagacaacgccaagaacaccctgttcctgcagatggacagcctgagacccgaggacaccggcgtgtacttctgcgccagcctgtacttcggcttcccctggttcgcctactggggccagggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31063 - RNA, 639 nt, synthetic construct
  misc_feature 1..639: note = derived and/or modified sequence opt4 from Labetuzumab_govitecan_LightChain1
  source 1..639: mol_type = other RNA
gacatccagctgacccagagccccagcagcctgagcgccagcgtgggcgacagagtgaccatcacctgcaaggccagccaggacgtgggcaccagcgtggcctggtaccagcagaagcccggcaaggcccccaagctgctgatctactggaccagcaccagacacaccggcgtgcccagcagattcagcggcagcggcagcggcaccgacttcaccttcaccatcagcagcctgcagcccgaggacatcgccacctactactgccagcagtacagcctgtacagaagcttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31064 - RNA, 1341 nt, synthetic construct
  misc_feature 1..1341: note = derived and/or modified sequence opt4 from Lambrolizumab_HeavyChain1
  source 1..1341: mol_type = other RNA
caggtgcagctggtgcagagcggcgtggaggtgaagaagcccggcgccagcgtgaaggtgagctgcaaggccagcggctacaccttcaccaactactacatgtactgggtgagacaggcccccggccagggcctggagtggatgggcggcatcaaccccagcaacggcggcaccaacttcaacgagaagttcaagaacagagtgaccctgaccaccgacagcagcaccaccaccgcctacatggagctgaagagcctgcagttcgacgacaccgccgtgtactactgcgccagaagagactacagattcgacatgggcttcgactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31065 - RNA, 654 nt, synthetic construct
  misc_feature 1..654: note = derived and/or modified sequence opt4 from Lambrolizumab_LightChain1
  source 1..654: mol_type = other RNA
gagatcgtgctgacccagagccccgccaccctgagcctgagccccggcgagagagccaccctgagctgcagagccagcaagggcgtgagcaccagcggctacagctacctgcactggtaccagcagaagcccggccaggcccccagactgctgatctacctggccagctacctggagagcggcgtgcccgccagattcagcggcagcggcagcggcaccgacttcaccctgaccatcagcagcctggagcccgaggacttcgccgtgtactactgccagcacagcagagacctgcccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31066 - RNA, 669 nt, synthetic construct
  misc_feature 1..669: note = derived and/or modified sequence opt4 from Lampalizumab_HeavyChain1
  source 1..669: mol_type = other RNA
gaggtgcagctggtgcagagcggccccgagctgaagaagcccggcgccagcgtgaaggtgagctgcaaggccagcggctacaccttcaccaactacggcatgaactgggtgagacaggcccccggccagggcctggagtggatgggctggatcaacacctacaccggcgagaccacctacgccgacgacttcaagggcagattcgtgttcagcctggacaccagcgtgagcaccgcctacctgcagatcagcagcctgaaggccgaggacaccgccgtgtactactgcgagagagagggcggcgtgaacaactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacc

SEQ ID NO: 31067 - RNA, 642 nt, synthetic construct
  misc_feature 1..642: note = derived and/or modified sequence opt4 from Lampalizumab_LightChain1
  source 1..642: mol_type = other RNA
gacatccaggtgacccagagccccagcagcctgagcgccagcgtgggcgacagagtgaccatcacctgcatcaccagcaccgacatcgacgacgacatgaactggtaccagcagaagcccggcaaggtgcccaagctgctgatcagcggcggcaacaccctgagacccggcgtgcccagcagattcagcggcagcggcagcggcaccgacttcaccctgaccatcagcagcctgcagcccgaggacgtggccacctactactgcctgcagagcgacagcctgccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31068 - RNA, 1353 nt, synthetic construct
  misc_feature 1..1353: note = derived and/or modified sequence opt4 from Lanadelumab_HeavyChain1
  source 1..1353: mol_type = other RNA
gaggtgcagctgctggagagcggcggcggcctggtgcagcccggcggcagcctgagactgagctgcgccgccagcggcttcaccttcagccactacatcatgatgtgggtgagacaggcccccggcaagggcctggagtgggtgagcggcatctacagcagcggcggcatcaccgtgtacgccgacagcgtgaagggcagattcaccatcagcagagacaacagcaagaacaccctgtacctgcagatgaacagcctgagagccgaggacaccgccgtgtactactgcgcctacagaagaatcggcgtgcccagaagagacgagttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31069 - RNA, 639 nt, synthetic construct
  misc_feature 1..639: note = derived and/or modified sequence opt4 from Lanadelumab_LightChain1
  source 1..639: mol_type = other RNA
gacatccagatgacccagagccccagcaccctgagcgccagcgtgggcgacagagtgaccatcacctgcagagccagccagagcatcagcagctggctggcctggtaccagcagaagcccggcaaggcccccaagctgctgatctacaaggccagcaccctggagagcggcgtgcccagcagattcagcggcagcggcagcggcaccgagttcaccctgaccatcagcagcctgcagcccgacgacttcgccacctactactgccagcagtacaacacctactggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31070 - RNA, 1317 nt, synthetic construct
  misc_feature 1..1317: note = derived and/or modified sequence opt4 from Landogrozumab_HeavyChain1
  source 1..1317: mol_type = other RNA
gaggtgcagctggtggagagcggcggcggcctggtgcagcccggcggcagcctgagactgagctgcgccgccagcggcctgaccttcagcagataccccatgagctgggtgagacaggcccccggcaagggcctggtgtgggtgagcgccatcaccagcagcggcggcagcacctactacagcgacaccgtgaagggcagattcaccatcagcagagacaacgccaagaacaccctgtacctgcagatgaacagcctgagagccgaggacaccgccgtgtactactgcgccagactgcccgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 31071 - RNA, 645 nt, synthetic construct
  misc_feature 1..645: note = derived and/or modified sequence opt4 from Landogrozumab_LightChain1
  source 1..645: mol_type = other RNA
gagatcgtgctgacccagagccccggcaccctgagcctgagccccggcgagagagccaccctgagctgcagagccagcagcagcgtgagcagcagctacctgcactggtaccagcagaagcccggccaggcccccagactgctgatctacagcaccagcaacctggtggccggcatccccgacagattcagcggcagcggcagcggcaccgacttcaccctgaccatcagcagactggagcccgaggacttcgccgtgtactactgccagcaccacagcggctaccacttcaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31072 - RNA, 1344 nt, synthetic construct
  misc_feature 1..1344: note = derived and/or modified sequence opt4 from Laprituximab_emtansine_HeavyChain1
  source 1..1344: mol_type = other RNA
caggtgcagctggtgcagagcggcgccgaggtggccaagcccggcgccagcgtgaagctgagctgcaaggccagcggctacaccttcaccagctactggatgcagtgggtgaagcagagacccggccagggcctggagtgcatcggcaccatctaccccggcgacggcgacaccacctacacccagaagttccagggcaaggccaccctgaccgccgacaagagcagcagcaccgcctacatgcagctgagcagcctgagaagcgaggacagcgccgtgtactactgcgccagatacgacgcccccggctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31073 - RNA, 642 nt, synthetic construct
  misc_feature 1..642: note = derived and/or modified sequence opt4 from Laprituximab_emtansine_LightChain1
  source 1..642: mol_type = other RNA
gacatccagatgacccagagccccagcagcctgagcgccagcgtgggcgacagagtgaccatcacctgcagagccagccaggacatcaacaactacctggcctggtaccagcacaagcccggcaagggccccaagctgctgatccactacaccagcaccctgcaccccggcatccccagcagattcagcggcagcggcagcggcagagactacagcttcagcatcagcagcctggagcccgaggacatcgccacctactactgcctgcagtacgacaacctgctgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31074 - RNA, 1314 nt, synthetic construct
  misc_feature 1..1314: note = derived and/or modified sequence opt4 from Lealesoab_HeavyChain1
  source 1..1314: mol_type = other RNA
caggtgcagctgcaggagagcggccccgagctgaagaagcccggcgagaccgtgaagatcagctgcaaggccagcggctacaccttcagaaactacggcaactgggtgaagcaggcccccggcaagggcctgaagtggggctggatcaacacctacaccggcgagcccacctacgccgacgacttcaagggcagattcgccttcagcctggagaccagcgccagcaccgcctacctgcagatcaacaacgtgaagaacgaggacaccgccacctacttctgcgccagaaagggctgggacttcaacggcagcagcctggactactggggccagggcaccaccgtgaccgtgagcagcgccaagaccaccccccccagcgtgtaccccctggcccccggcagcgccgcccagaccaacagcgtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagccccagacccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctggttcgtggacgacgtggaggtgcacaccgcccagacccagcccagagaggagcagttcaacagcaccttcagaagcgtgagcgagctgcccatccaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcaggccaaggacaaggtgagcctgacctgcatcaccgacttcttccccgaggacatcaccgtggagtggcagtggaacggccagcccgccgagaactacaagaacacccagcccatcaacaccaacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 31075 - RNA, 654 nt, synthetic construct
  misc_feature 1..654: note = derived and/or modified sequence opt4 from Lealesoab_LightChain1
  source 1..654: mol_type = other RNA
gacatccagctgacccagacccccctgagcctgcccgtgagcctgggcgaccaggccagcatcagctgcagaagcagccagagcatcgtgcacagcaacggcaacacctacctggagtggtacctgcagaagcccggccagagccccaacctgctgatctacaaggtgagcaacagattcagcggcgtgcccgacagattcagcggcagcggcagcggcaccgacttcaccctgaagatcagcagagtggaggccgaggacctgggcgtgtactactgcttccagggcagccacgtgccccccaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcagcagcaccctgaccctgaccaaggacgagtacgagagacacaacagctacacctgcgaggccacccacaagaccagcaccagccccatcgtgaagagcttcaacagaaacgagtgc

SEQ ID NO: 31076 - RNA, 1335 nt, synthetic construct
  misc_feature 1..1335: note = derived and/or modified sequence opt4 from Lebrikizumab_HeavyChain1
  source 1..1335: mol_type = other RNA
caggtgaccctgagagagagcggccccgccctggtgaagcccacccagaccctgaccctgacctgcaccgtgagcggcttcagcctgagcgcctacagcgtgaactggatcagacagccccccggcaaggccctggagtggctggccatgatctggggcgacggcaagatcgtgtacaacagcgccctgaagagcagactgaccatcagcaaggacaccagcaagaaccaggtggtgctgaccatgaccaacatggaccccgtggacaccgccacctactactgcgccggcgacggctactacccctacgccatggacaactggggccagggcagcctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31077 - RNA, 654 nt, synthetic construct
  misc_feature 1..654: note = derived and/or modified sequence opt4 from Lebrikizumab_LightChain1
  source 1..654: mol_type = other RNA
gacatcgtgatgacccagagccccgacagcctgagcgtgagcctgggcgagagagccaccatcaactgcagagccagcaagagcgtggacagctacggcaacagcttcatgcactggtaccagcagaagcccggccagccccccaagctgctgatctacctggccagcaacctggagagcggcgtgcccgacagattcagcggcagcggcagcggcaccgacttcaccctgaccatcagcagcctgcaggccgaggacgtggccgtgtactactgccagcagaacaacgaggaccccagaaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31078 - RNA, 1227 nt, synthetic construct
  misc_feature 1..1227: note = derived and/or modified sequence opt4 from Lenercept_chain1
  source 1..1227: mol_type = other RNA
ctggtgccccacctgggcgacagagagaagagagacagcgtgtgcccccagggcaagtacatccacccccagaacaacagcatctgctgcaccaagtgccacaagggcacctacctgtacaacgactgccccggccccggccaggacaccgactgcagagagtgcgagagcggcagcttcaccgccagcgagaaccacctgagacactgcctgagctgcagcaagtgcagaaaggagatgggccaggtggagatcagcagctgcaccgtggacagagacaccgtgtgcggctgcagaaagaaccagtacagacactactggagcgagaacctgttccagtgcttcaactgcagcctgtgcctgaacggcaccgtgcacctgagctgccaggagaagcagaacaccgtgtgcacctgccacgccggcttcttcctgagagagaacgagtgcgtgagctgcagcaactgcaagaagagcctggagtgcaccaagctgtgcctgccccagatcgagaacgtgaagggcaccgaggacagcggcaccaccgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31079 - RNA, 1347 nt, synthetic construct
  misc_feature 1..1347: note = derived and/or modified sequence opt4 from Lenzilumab_HeavyChain1
  source 1..1347: mol_type = other RNA
caggtgcagctggtgcagagcggcgccgaggtgaagaagcccggcgccagcgtgaaggtgagctgcaaggccagcggctacagcttcaccaactactacatccactgggtgagacaggcccccggccagagactggagtggatgggctggatcaacgccggcaacggcaacaccaagtacagccagaagttccagggcagagtgaccatcaccagagacaccagcgccagcaccgcctacatggagctgagcagcctgagaagcgaggacaccgccgtgtactactgcgtgagaagacagagattcccctactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31080 - RNA, 642 nt, synthetic construct
  misc_feature 1..642: note = derived and/or modified sequence opt4 from Lenzilumab_LightChain1
  source 1..642: mol_type = other RNA
gagatcgtgctgacccagagccccgccaccctgagcgtgagccccggcgagagagccaccctgagctgcagagccagccagagcgtgggcaccaacgtggcctggtaccagcagaagcccggccaggcccccagagtgctgatctacagcaccagcagcagagccaccggcatcaccgacagattcagcggcagcggcagcggcaccgacttcaccctgaccatcagcagactggagcccgaggacttcgccgtgtactactgccagcagttcaacaagagccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31081 - RNA, 1326 nt, synthetic construct
  misc_feature 1..1326: note = derived and/or modified sequence opt4 from Lerdelimumab_HeavyChain1
  source 1..1326: mol_type = other RNA
gaggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatctggtacgacggcagcaacaagtactacgccgacagcgtgaagggcagattcaccatcagcagagacaacagcaagaacaccctgtacctgcagatggacagcctgagagccgaggacaccgccgtgtactactgcggcagaaccctggagagcagcctgtggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31082 - RNA, 645 nt, synthetic construct
  misc_feature 1..645: note = derived and/or modified sequence opt4 from Lerdelimumab_LightChain1
  source 1..645: mol_type = other RNA
agcagcgagctgacccaggaccccgccgtgagcgtggccctgggccagaccgtgagaatcacctgccagggcgacagcctgagaagctactacgccagctggtaccagcagaagcccggccaggcccccgtgctggtgatctacggcaagaacaacagacccagcggcatccccgacagattcagcggcagcagcagcggcaacaccgccagcctgaccatcaccggcgcccaggccgaggacgaggccgactactactgcaacagcagagacagcagcagcacccacagaggcgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31083 - RNA, 1353 nt, synthetic construct
  misc_feature 1..1353: note = derived and/or modified sequence opt4 from Lexatumumab_HeavyChain1
  source 1..1353: mol_type = other RNA
gaggtgcagctggtgcagagcggcggcggcgtggagagacccggcggcagcctgagactgagctgcgccgccagcggcttcaccttcgacgactacggcatgagctgggtgagacaggcccccggcaagggcctggagtgggtgagcggcatcaactggaacggcggcagcaccggctacgccgacagcgtgaagggcagagtgaccatcagcagagacaacgccaagaacagcctgtacctgcagatgaacagcctgagagccgaggacaccgccgtgtactactgcgccaagatcctgggcgccggcagaggctggtacttcgacctgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31084 - RNA, 1353 nt, synthetic construct; identical to SEQ ID NO: 31083
  misc_feature 1..1353: note = derived and/or modified sequence opt4 from Lexatumumab_HeavyChain
  source 1..1353: mol_type = other RNA

SEQ ID NO: 31085 - RNA, 642 nt, synthetic construct
  misc_feature 1..642: note = derived and/or modified sequence opt4 from Lexatumumab_LightChain1
  source 1..642: mol_type = other RNA
agcagcgagctgacccaggaccccgccgtgagcgtggccctgggccagaccgtgagaatcacctgccagggcgacagcctgagaagctactacgccagctggtaccagcagaagcccggccaggcccccgtgctggtgatctacggcaagaacaacagacccagcggcatccccgacagattcagcggcagcagcagcggcaacaccgccagcctgaccatcaccggcgcccaggccgaggacgaggccgactactactgcaacagcagagacagcagcggcaaccacgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31086 - RNA, 642 nt, synthetic construct; identical to SEQ ID NO: 31085
  misc_feature 1..642: note = derived and/or modified sequence opt4 from Lexatumumab_LightChain
  source 1..642: mol_type = other RNA

SEQ ID NO: 31087 - RNA, 1377 nt, synthetic construct
  misc_feature 1..1377: note = derived and/or modified sequence opt4 from Libivirumab_HeavyChain1
  source 1..1377: mol_type = other RNA
caggtgcagctggtggagagcggcggcggcgtggtgagacccggcagaagcctgagactgagctgcgccgccagcggcttcgccttcagcgactacagcatcaactgggtgagacaggcccccggcaagggcctggagtgggtggccatcatcagctacgacggcagaatcacctactacagagacagcgtgaagggcagattcaccatcagcagagacgacagcaagaacaccctgtacctgcagatgaacagcctgagaaccgaggacaccgccgtgtactactgcgccagacagtactacgacttctggagcggcagcagcgtgggcagaaactacgacggcatggacgtgtggggcctgggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31088 - RNA, 657 nt, synthetic construct
  misc_feature 1..657: note = derived and/or modified sequence opt4 from Libivirumab_LightChain1
  source 1..657: mol_type = other RNA
gacatcgtgatgacccagagccccctgagcctgagcgtgacccccggcgagcccgccagcatcagctgcagaagcagccagagcctgctgcacagaagcggcaacaactacctggactggtacctgcagaagcccggccacagcccccagctgctgatctacgtgggcagcaacagagccagcggcgtgcccgacagattcagcggcagcggcagcggcaccgagtacaccctgaagatcagcagagtggaggccgaggacgtgggcgtgtactactgcatgcaggccctgcagacccccagaaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31089 - RNA, 1350 nt, synthetic construct
  misc_feature 1..1350: note = derived and/or modified sequence opt4 from Lifastuzumab_HeavyChain
  source 1..1350: mol_type = other RNA
gaggtgcagctggtggagagcggcggcggcctggtgcagcccggcggcagcctgagactgagctgcgccgccagcggcttcagcttcagcgacttcgccatgagctgggtgagacaggcccccggcaagggcctggagtgggtggccaccatcggcagagtggccttccacacctactaccccgacagcatgaagggcagattcaccatcagcagagacaacagcaagaacaccctgtacctgcagatgaacagcctgagagccgaggacaccgccgtgtactactgcgccagacacagaggcttcgacgtgggccacttcgacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31090 - RNA, 657 nt, synthetic construct
  misc_feature 1..657: note = derived and/or modified sequence opt4 from Lifastuzumab_LightChain
  source 1..657: mol_type = other RNA
gacatccagatgacccagagccccagcagcctgagcgccagcgtgggcgacagagtgaccatcacctgcagaagcagcgagaccctggtgcacagcagcggcaacacctacctggagtggtaccagcagaagcccggcaaggcccccaagctgctgatctacagagtgagcaacagattcagcggcgtgcccagcagattcagcggcagcggcagcggcaccgacttcaccctgaccatcagcagcctgcagcccgaggacttcgccacctactactgcttccagggcagcttcaaccccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31091 - RNA, 1347 nt, synthetic construct
  misc_feature 1..1347: note = derived and/or modified sequence opt4 from Lifastuzumab_vedotin_HeavyChain1
  source 1..1347: mol_type = other RNA
gtgcagctggtggagagcggcggcggcctggtgcagcccggcggcagcctgagactgagctgcgccgccagcggcttcagcttcagcgacttcgccatgagctgggtgagacaggcccccggcaagggcctggagtgggtggccaccatcggcagagtggccttccacacctactaccccgacagcatgaagggcagattcaccatcagcagagacaacagcaagaacaccctgtacctgcagatgaacagcctgagagccgaggacaccgccgtgtactactgcgccagacacagaggcttcgacgtgggccacttcgacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31092 - RNA, 657 nt, synthetic construct; identical to SEQ ID NO: 31090
  misc_feature 1..657: note = derived and/or modified sequence opt4 from Lifastuzumab_vedotin_LightChain1
  source 1..657: mol_type = other RNA

SEQ ID NO: 31093 - RNA, 1359 nt, synthetic construct
  misc_feature 1..1359: note = derived and/or modified sequence opt4 from Ligelizumab_HeavyChain1
  source 1..1359: mol_type = other RNA
caggtgcagctggtgcagagcggcgccgaggtgatgaagcccggcagcagcgtgaaggtgagctgcaaggccagcggctacaccttcagctggtactggctggagtgggtgagacaggcccccggccacggcctggagtggatgggcgagatcgaccccggcaccttcaccaccaactacaacgagaagttcaaggccagagtgaccttcaccgccgacaccagcaccagcaccgcctacatggagctgagcagcctgagaagcgaggacaccgccgtgtactactgcgccagattcagccacttcagcggcagcaactacgactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31094 - RNA, 642 nt, synthetic construct
  misc_feature 1..642: note = derived and/or modified sequence opt4 from Ligelizumab_LightChain1
  source 1..642: mol_type = other RNA
gagatcgtgatgacccagagccccgccaccctgagcgtgagccccggcgagagagccaccctgagctgcagagccagccagagcatcggcaccaacatccactggtaccagcagaagcccggccaggcccccagactgctgatctactacgccagcgagagcatcagcggcatccccgccagattcagcggcagcggcagcggcaccgagttcaccctgaccatcagcagcctgcagagcgaggacttcgccgtgtactactgccagcagagctggagctggcccaccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31095 - RNA, 1329 nt, synthetic construct; identical to SEQ ID NO: 30643
  misc_feature 1..1329: note = derived and/or modified sequence opt4 from Lilotomab_HeavyChain1
  source 1..1329: mol_type = other RNA

SEQ ID NO: 31096 - RNA, 642 nt, synthetic construct; identical to SEQ ID NO: 30644
  misc_feature 1..642: note = derived and/or modified sequence opt4 from Lilotomab_LightChain1
  source 1..642: mol_type = other RNA

SEQ ID NO: 31097 - RNA, 1338 nt, synthetic construct
  misc_feature 1..1338: note = derived and/or modified sequence opt4 from Lintuzumab_HeavyChain1
  source 1..1338: mol_type = other RNA
caggtgcagctggtgcagagcggcgccgaggtgaagaagcccggcagcagcgtgaaggtgagctgcaaggccagcggctacaccttcaccgactacaacatgcactgggtgagacaggcccccggccagggcctggagtggatcggctacatctacccctacaacggcggcaccggctacaaccagaagttcaagagcaaggccaccatcaccgccgacgagagcaccaacaccgcctacatggagctgagcagcctgagaagcgaggacaccgccgtgtactactgcgccagaggcagacccgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31098 - RNA, 654 nt, synthetic construct
  misc_feature 1..654: note = derived and/or modified sequence opt4 from Lintuzumab_LightChain1
  source 1..654: mol_type = other RNA
gacatccagatgacccagagccccagcagcctgagcgccagcgtgggcgacagagtgaccatcacctgcagagccagcgagagcgtggacaactacggcatcagcttcatgaactggttccagcagaagcccggcaaggcccccaagctgctgatctacgccgccagcaaccagggcagcggcgtgcccagcagattcagcggcagcggcagcggcaccgacttcaccctgaccatcagcagcctgcagcccgacgacttcgccacctactactgccagcagagcaaggaggtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31099 - RNA, 1350 nt, synthetic construct
  misc_feature 1..1350: note = derived and/or modified sequence opt4 from Lirilumab_HeavyChain1
  source 1..1350: mol_type = other RNA
caggtgcagctggtgcagagcggcgccgaggtgaagaagcccggcagcagcgtgaaggtgagctgcaaggccagcggcggcaccttcagcttctacgccatcagctgggtgagacaggcccccggccagggcctggagtggatgggcggcttcatccccatcttcggcgccgccaactacgcccagaagttccagggcagagtgaccatcaccgccgacgagagcaccagcaccgcctacatggagctgagcagcctgagaagcgacgacaccgccgtgtactactgcgccagaatccccagcggcagctactactacgactacgacatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31100 - RNA, 642 nt, synthetic construct
  misc_feature 1..642: note = derived and/or modified sequence opt4 from Lirilumab_LightChain1
  source 1..642: mol_type = other RNA
gagatcgtgctgacccagagccccgtgaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggatgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31101 - RNA, 1344 nt, synthetic construct
  misc_feature 1..1344: note = derived and/or modified sequence opt4 from Lodelcizumab_HeavyChain1
  source 1..1344: mol_type = other RNA
caggtgcagctggtgcagagcggcgccgaggtgaagaagcccggcgccagcgtgaaggtgagctgcaaggccagcggctacaccttcagcaccatgtacatgagctgggtgagacaggcccccggccagggcctggagtggatgggcagaatcgaccccgccaacgagcacaccaactacgcccagaagttccagggcagagtgaccatgaccagagacaccagcatcagcaccgcctacatggagctgagcagactgaccagcgacgacaccgccgtgtactactgcgccagaagctactactactacaacatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31102 - RNA, 639 nt, synthetic construct
  misc_feature 1..639: note = derived and/or modified sequence opt4 from Lodelcizumab_LightChain1
  source 1..639: mol_type = other RNA
cagatcgtgctgacccagagccccgccaccctgagcgtgagccccggcgagagagccaccctgagctgcagagccagccagagcgtgagctacatgcactggtaccagcagaagcccggccaggcccccagactgctgatctacggcgtgttcagaagagccaccggcatccccgacagattcagcggcagcggcagcggcaccgacttcaccctgaccatcggcagactggagcccgaggacttcgccgtgtactactgcctgcagtggagcagcgacccccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31103 - RNA, 1356 nt, synthetic construct
  misc_feature 1..1356: note = derived and/or modified sequence opt4 from Lokivetmab_HeavyChain1
  source 1..1356: mol_type = other RNA
gaggtgcagctggtggagagcggcggcgacctggtgaagcccggcggcagcctgagactgagctgcgtggccagcggcttcaccttcagcaactacggcatgagctgggtgagacaggcccccggcaagggcctgcagtgggtggccaccatcagctacggcggcagctacacctactaccccgacaacatcaagggcagattcaccatcagcagagacaacgccaagaacaccctgtacctgcagatgaacagcctgagagccgaggacaccgccatgtactactgcgtgagaggctacggctacgacaccatggactactggggccagggcaccctggtgaccgtgagcagcgccagcaccaccgcccccagcgtgttccccctggcccccagctgcggcagcaccagcggcagcaccgtggccctggcctgcctggtgagcggctacttccccgagcccgtgaccgtgagctggaacagcggcagcctgaccagcggcgtgcacaccttccccagcgtgctgcagagcagcggcctgtacagcctgagcagcatggtgaccgtgcccagcagcagatggcccagcgagaccttcacctgcaacgtggcccaccccgccagcaagaccaaggtggacaagcccgtgcccaagagagagaacggcagagtgcccagaccccccgactgccccaagtgccccgcccccgagatgctgggcggccccagcgtgttcatcttcccccccaagcccaaggacaccctgctgatcgccagaacccccgaggtgacctgcgtggtggtggacctggaccccgaggaccccgaggtgcagatcagctggttcgtggacggcaagcagatgcagaccgccaagacccagcccagagaggagcagttcaacggcacctacagagtggtgagcgtgctgcccatcggccaccaggactggctgaagggcaagcagttcacctgcaaggtgaacaacaaggccctgcccagccccatcgagagaaccatcagcaaggccagaggccaggcccaccagcccagcgtgtacgtgctgccccccagcagagaggagctgagcaagaacaccgtgagcctgacctgcctgatcaaggacttcttcccccccgacatcgacgtggagtggcagagcaacggccagcaggagcccgagagcaagtacagaaccacccccccccagctggacgaggacggcagctacttcctgtacagcaagctgagcgtggacaagagcagatggcagagaggcgacaccttcatctgcgccgtgatgcacgaggccctgcacaaccactacacccaggagagcctgagccacagccccggc

SEQ ID NO: 31104 - RNA, 651 nt, synthetic construct
  misc_feature 1..651: note = derived and/or modified sequence opt4 from Lokivetmab_LightChain1
  source 1..651: mol_type = other RNA
gagatcgtgatgacccagagccccgccagcctgagcctgagccaggaggagaaggtgaccatcacctgcaaggccagccagagcgtgagcttcgccggcaccggcctgatgcactggtaccagcagaagcccggccaggcccccaagctgctgatctacagagccagcaacctggaggccggcgtgcccagcagattcagcggcagcggcagcggcaccgacttcagcttcaccatcagcagcctggagcccgaggacgtggccgtgtactactgccagcagagcagagagtacccctggaccttcggccagggcaccaagctggagatcaagagaaacgacgcccagcccgccgtgtacctgttccagcccagccccgaccagctgcacaccggcagcgccagcgtggtgtgcctgctgaacagcttctaccccaaggacatcaacgtgaagtggaaggtggacggcgtgatccaggacaccggcatccaggagagcgtgaccgagcaggacaaggacagcacctacagcctgagcagcaccctgaccatgagcagcaccgagtacctgagccacgagctgtacagctgcgagatcacccacaagagcctgcccagcaccctgatcaagagcttccagagaagcgagtgc

SEQ ID NO: 31105 - RNA, 1344 nt, synthetic construct
  misc_feature 1..1344: note = derived and/or modified sequence opt4 from Lorvotuzumab_mertansine_HeavyChain1
  source 1..1344: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggcctacatcagcagcggcagcttcaccatctactacgccgacagcgtgaagggcagattcaccatcagcagagacaacagcaagaacaccctgtacctgcagatgaacagcctgagagccgaggacaccgccgtgtactactgcgccagaatgagaaagggctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31106 - RNA, 657 nt, synthetic construct
  misc_feature 1..657: note = derived and/or modified sequence opt4 from Lorvotuzumab_mertansine_LightChain1
  source 1..657: mol_type = other RNA
gacgtggtgatgacccagagccccctgagcctgcccgtgaccctgggccagcccgccagcatcagctgcagaagcagccagatcatcatccacagcgacggcaacacctacctggagtggttccagcagagacccggccagagccccagaagactgatctacaaggtgagcaacagattcagcggcgtgcccgacagattcagcggcagcggcagcggcaccgacttcaccctgaagatcagcagagtggaggccgaggacgtgggcgtgtactactgcttccagggcagccacgtgccccacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31107 - RNA, 336 nt, synthetic construct
  misc_feature 1..336: note = derived and/or modified sequence opt4 from Lpathomab_VL
  source 1..336: mol_type = other RNA
gacgtggtgatgacccagacccccctgagcctgcccgtgagcctgggcgaccaggccagcatcagctgcaccagcggccagagcctggtgcacatcaacggcaacacctacctgcactggtacctgcagaagcccggccagagccccaagctgctgatctacaaggtgagcaacctgttcagcggcgtgcccgacagattcagcggcagcggcagcggcaccgacttcaccctgaagatcagcagagtggaggccgaggacctgggcgtgtacttctgcagccagagcacccacttccccttcaccttcggcaccggcaccaagctggagatcaag

SEQ ID NO: 31108 - RNA, 366 nt, synthetic construct
  misc_feature 1..366: note = derived and/or modified sequence opt4 from Lpathomab_gamma1-Chain_VDJ-Region
  source 1..366: mol_type = other RNA
caggtgcagctgcagcagagcggcgccgagctggtgagacccggcaccagcgtgaaggtgagctgcaaggccagcggctacggcttcatcaactacctgatcgagtggatcaagcagagacccggccagggcctggagtggatcggcctgatcaaccccggcagcgactacaccaactacaacgagaacttcaagggcaaggccaccctgaccgccgacaagagcagcagcaccgcctacatgcacctgagcagcctgaccagcgaggacagcgccgtgtacttctgcgccagaagattcggctactacggcagcggcaactacttcgactactggggccagggcaccaccctgaccgtgagcagc

SEQ ID NO: 31109 - RNA, 1350 nt, synthetic construct
  misc_feature 1..1350: note = derived and/or modified sequence opt4 from Lucatumumab_HeavyChain1
  source 1..1350: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgaggagagcaacagataccacgccgacagcgtgaagggcagattcaccatcagcagagacaacagcaagatcaccctgtacctgcagatgaacagcctgagaaccgaggacaccgccgtgtactactgcgccagagacggcggcatcgccgcccccggccccgactactggggccagggcaccctggtgaccgtgagcagcgccagcaccaagggccccagcgtgttccccctggcccccgccagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31110 - RNA, 657 nt, synthetic construct
  misc_feature 1..657: note = derived and/or modified sequence opt4 from Lucatumumab_LightChain1
  source 1..657: mol_type = other RNA
gacatcgtgatgacccagagccccctgagcctgaccgtgacccccggcgagcccgccagcatcagctgcagaagcagccagagcctgctgtacagcaacggctacaactacctggactggtacctgcagaagcccggccagagcccccaggtgctgatcagcctgggcagcaacagagccagcggcgtgcccgacagattcagcggcagcggcagcggcaccgacttcaccctgaagatcagcagagtggaggccgaggacgtgggcgtgtactactgcatgcaggccagacagacccccttcaccttcggccccggcaccaaggtggacatcagaagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31111 - RNA, 324 nt, synthetic construct
  misc_feature 1..324: note = derived and/or modified sequence opt4 from Lulizumab_pegol_LightChain1
  source 1..324: mol_type = other RNA
gacatccagatgacccagagccccagcagcctgagcgccagcgtgggcgacagagtgaccatcacctgcagagccagcagacccatctggcccttcctggagtggtaccagcagaagcccggcaaggcccccaagctgctgatctacttcaccagcagactgagacacggcgtgcccagcagattcagcggcagcggcagcggcacctgcttcaccctgaccatcagcagcctgcagcccgaggacttcgccacctactactgcctgcagaacgtggccaaccccgccaccttcagccagggcaccaaggtggagatcaagaga

SEQ ID NO: 31112 - RNA, 324 nt, synthetic construct; identical to SEQ ID NO: 31111
  misc_feature 1..324: note = derived and/or modified sequence opt4 from Lulizumab_pegol_LightChain
  source 1..324: mol_type = other RNA

SEQ ID NO: 31113 - RNA, 1194 nt, synthetic construct
  misc_feature 1..1194: note = derived and/or modified sequence opt4 from Lumiliximab_HeavyChain1
  source 1..1194: mol_type = other RNA
gaggtgcagctggtggagagcggcggcggcctggccaagcccggcggcagcctgagactgagctgcgccgccagcggcttcagattcaccttcaacaactactacatggactgggtgagacaggcccccggccagggcctggagtgggtgctgaccaccggcagcgacagctggggccagggcgtgctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31114 - RNA, 642 nt, synthetic construct
  misc_feature 1..642: note = derived and/or modified sequence opt4 from Lumiliximab_LightChain1
  source 1..642: mol_type = other RNA
gacatccagatgacccagagccccagcagcctgagcgccagcgtgggcgacagagtgaccatcacctgcagagccagccaggacatcagatactacctgaactggtaccagcagaagcccggcaaggcccccaagctgctgatctacgtggccagcagcctgcagagcggcgtgcccagcagattcagcggcagcggcagcggcaccgagttcaccctgaccgtgagcagcctgcagcccgaggacttcgccacctactactgcctgcaggtgtacagcacccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31115 - RNA, 1347 nt, synthetic construct
  misc_feature 1..1347: note = derived and/or modified sequence opt4 from Lumretuzumab_HeavyChain1
  source 1..1347: mol_type = other RNA
caggtgcagctggtgcagagcggcgccgaggtgaagaagcccggcgccagcgtgaaggtgagctgcaaggccagcggctacaccttcagaagcagctacatcagctgggtgagacaggcccccggccagggcctggagtggatgggctggatctacgccggcaccggcagccccagctacaaccagaagctgcagggcagagtgaccatgaccaccgacaccagcaccagcaccgcctacatggagctgagaagcctgagaagcgacgacaccgccgtgtactactgcgccagacacagagactactacagcaacagcctgacctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31116 - RNA, 660 nt, synthetic construct
  misc_feature 1..660: note = derived and/or modified sequence opt4 from Lumretuzumab_LightChain1
  source 1..660: mol_type = other RNA
gacatcgtgatgacccagagccccgacagcctggccgtgagcctgggcgagagagccaccatcaactgcaagagcagccagagcgtgctgaacagcggcaaccagaagaactacctgacctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagagcgactacagctacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31117 - RNA, 1329 nt, synthetic construct; identical to SEQ ID NO: 30643
  misc_feature 1..1329: note = derived and/or modified sequence opt4 from Lutetium_(177Lu)_lilotomab_satetraxetan_HeavyChain1
  source 1..1329: mol_type = other RNA

SEQ ID NO: 31118 - RNA, 642 nt, synthetic construct; identical to SEQ ID NO: 30644
  misc_feature 1..642: note = derived and/or modified sequence opt4 from Lutetium_(177Lu)_lilotomab_satetraxetan_LightChain1
  source 1..642: mol_type = other RNA

SEQ ID NO: 31119 - RNA, 1350 nt, synthetic construct
  misc_feature 1..1350: note = derived and/or modified sequence opt4 from Margetuximab_HeavyChain1
  source 1..1350: mol_type = other RNA
caggtgcagctgcagcagagcggccccgagctggtgaagcccggcgccagcctgaagctgagctgcaccgccagcggcttcaacatcaaggacacctacatccactgggtgaagcagagacccgagcagggcctggagtggatcggcagaatctaccccaccaacggctacaccagatacgaccccaagttccaggacaaggccaccatcaccgccgacaccagcagcaacaccgcctacctgcaggtgagcagactgaccagcgaggacaccgccgtgtactactgcagcagatggggcggcgacggcttctacgccatggactactggggccagggcgccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctggtgggcggccccagcgtgttcctgctgccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagccccccgaggagcagtacaacagcaccctgagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccacccccctggtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31120 - RNA, 642 nt, synthetic construct
  misc_feature 1..642: note = derived and/or modified sequence opt4 from Margetuximab_LightChain1
  source 1..642: mol_type = other RNA
gacatcgtgatgacccagagccacaagttcatgagcaccagcgtgggcgacagagtgagcatcacctgcaaggccagccaggacgtgaacaccgccgtggcctggtaccagcagaagcccggccacagccccaagctgctgatctacagcgccagcttcagatacaccggcgtgcccgacagattcaccggcagcagaagcggcaccgacttcaccttcaccatcagcagcgtgcaggccgaggacctggccgtgtactactgccagcagcactacaccaccccccccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31121 - RNA, 762 nt, synthetic construct
  misc_feature 1..762: note = derived and/or modified sequence opt4 from Marzeptacog_alfa_HeavyChain1
  source 1..762: mol_type = other RNA
atcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggagaaacctgatcgccgtgctgggcgagcacgacctgagcgagcacgacggcgacgagcagagcagaagagtggcccaggtgatcatccccagcacctacgtgcccggcaccaccaaccacgacatcgccctgctgagactgcaccagcccgtggtgctgaccgaccacgtggtgcccctgtgcctgcccgagagaaccttcagcgagagaaccctggccttcgtgagattcagcctggtgagcggctggggcagactgctggacagaggcgccaccgccctggagctgcaggtgctgaacgtgcccagactgatgacccaggactgcctgcagcagagcagaaaggtgggcgacagccccaacatcaccgagtacatgttctgcgccggctacagcgacggcagcaaggacagctgcaagggcgacagcggcggcccccacgccacccactacagaggcacctggtacctgaccggcatcgtgagctggggccagggctgcgccaccgtgggccacttcggcgtgtacaccagagtgagccagtacatcgagtggctgcagaagctgatgagaagcgagcccagacccggcgtgctgctgagagcccccttcccc

SEQ ID NO: 31122 - RNA, 456 nt, synthetic construct
  misc_feature 1..456: note = derived and/or modified sequence opt4 from Marzeptacog_alfa_LightChain1
  source 1..456: mol_type = other RNA
gccaacgccttcctggaggagctgagacccggcagcctggagagagagtgcaaggaggagcagtgcagcttcgaggaggccagagagatcttcaaggacgccgagagaaccaagctgttctggatcagctacagcgacggcgaccagtgcgccagcagcccctgccagaacggcggcagctgcaaggaccagctgcagagctacatctgcttctgcctgcccgccttcgagggcagaaactgcgagacccacaaggacgaccagctgatctgcgtgaacgagaacggcggctgcgagcagtactgcagcgaccacaccggcaccaagagaagctgcagatgccacgagggctacagcctgctggccgacggcgtgagctgcaacgccaccgtggagtacccctgcggcaagatccccatcctggagaagagaaacgccagcaagccccagggcaga

SEQ ID NO: 31123 - RNA, 669 nt, synthetic construct
  misc_feature 1..669: note = derived and/or modified sequence opt4 from Matuzumab_HeavyChain1_variant_3c08_H
  source 1..669: mol_type = other RNA
caggtgcagctggtgcagagcggcgccgaggtgaagaagcccggcgccagcgtgaaggtgagctgcaaggccagcggctacaccttcaccagccactggatgcactgggtgagacaggcccccggccagggcctggagtggatcggcgagttcaaccccagcaacggcagaaccaactacaacgagaagttcaagagcaaggccaccatgaccgtggacaccagcaccaacaccgcctacatggagctgagcagcctgagaagcgaggacaccgccgtgtactactgcgccagcagagactacgactacgacggcagatacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagc

SEQ ID NO: 31124 - RNA, 669 nt, synthetic construct
  misc_feature 1..669: note = derived and/or modified sequence opt4 from Matuzumab_HeavyChain1_variant_3c09_C
  source 1..669: mol_type = other RNA
caggtgcagctggtgcagagcggcgccgaggtgaagaagcccggcgccagcgtgaaggtgagctgcaaggccagcggctacaccttcaccagccactggatgcactgggtgagacaggcccccggccagggcctggagtggatcggcgagttcaaccccagcaacggcagaaccaactacaacgagaagttcaagagcaaggccaccatgaccgtggacaccagcaccaacaccgcctacatggagctgagcagcctgagaagcgaggacaccgccgtgtactactgcgccagcagagactacgactacgccggcagatacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagc

SEQ ID NO: 31125 - RNA, 636 nt, synthetic construct
  misc_feature 1..636: note = derived and/or modified sequence opt4 from Matuzumab_LightChain1_variant_3c08_L
  source 1..636: mol_type = other RNA
gacatccagatgacccagagccccagcagcctgagcgccagcgtgggcgacagagtgaccatcacctgcagcgccagcagcagcgtgacctacatgtactggtaccagcagaagcccggcaaggcccccaagctgctgatctacgacaccagcaacctggccagcggcgtgcccagcagattcagcggcagcggcagcggcaccgactacaccttcaccatcagcagcctgcagcccgaggacatcgccacctactactgccagcagtggagcagccacatcttcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgag

SEQ ID NO: 31126 - RNA, 636 nt, synthetic construct; identical to SEQ ID NO: 31125
  misc_feature 1..636: note = derived and/or modified sequence opt4 from Matuzumab_LightChain1_variant_3c09_B
  source 1..636: mol_type = other RNA

SEQ ID NO: 31127 - RNA, 1341 nt, synthetic construct
  misc_feature 1..1341: note = derived and/or modified sequence opt4 from Mavrilimumab_HeavyChain1
  source 1..1341: mol_type = other RNA
caggtgcagctggtgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgaccccgaggagaacgagatcgtgtacgcccagagattccagggcagagtgaccatgaccgaggacaccagcaccgacaccgcctacatggagctgagcagcctgagaagcgaggacaccgccgtgtactactgcgccatcgtgggcagcttcagccccctgaccctgggcctgtggggccagggcaccatggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31128 - RNA, 651 nt, synthetic construct
  misc_feature 1..651: note = derived and/or modified sequence opt4 from Mavrilimumab_LightChain1
  source 1..651: mol_type = other RNA
cagagcgtgctgacccagccccccagcgtgagcggcgcccccggccagagagtgaccatcagctgcaccggcagcggcagcaacatcggcgccccctacgacgtgagctggtaccagcagctgcccggcaccgcccccaagctgctgatctaccacaacaacaagagacccagcggcgtgcccgacagattcagcggcagcaagagcggcaccagcgccagcctggccatcaccggcctgcaggccgaggacgaggccgactactactgcgccaccgtggaggccggcctgagcggcagcgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31129 - RNA, 1359 nt, synthetic construct
  misc_feature 1..1359: note = derived and/or modified sequence opt4 from MDX-1303_HeavyChain1
  source 1..1359: mol_type = other RNA
caggtgcagctggtggagagcggcggcggcgtggtgcagcccggcagaagcctgagactgagctgcgccgccagcggcttcaccttcagctactacggcatgcactgggtgagacaggcccccggcaagggcctggagtgggtggccgtgatctggcacgacgagagcatcgtgtactacgccgacagcgtgaagggcagattcaccatcagcagagacaacagcaagaacaccctgtacctgcagatgaacagcctgagagccgaggacaccgccgtgtactactgcaccagagaccccggcgacccctactactactactacggcctggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31130 - RNA, 645 nt, synthetic construct
  misc_feature 1..645: note = derived and/or modified sequence opt4 from MDX-1303_LightChain1
  source 1..645: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcatgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31131 - RNA, 1347 nt, synthetic construct
  misc_feature 1..1347: note = derived and/or modified sequence opt4 from Mepolizumab_HeavyChain1
  source 1..1347: mol_type = other RNA
caggtgaccctgagagagagcggccccgccctggtgaagcccacccagaccctgaccctgacctgcaccgtgagcggcttcagcctgaccagctacagcgtgcactgggtgagacagccccccggcaagggcctggagtggctgggcgtgatctgggccagcggcggcaccgactacaacagcgccctgatgagcagactgagcatcagcaaggacaccagcagaaaccaggtggtgctgaccatgaccaacatggaccccgtggacaccgccacctactactgcgccagagacccccccagcagcctgctgagactggactactggggcagaggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31132 - RNA, 660 nt, synthetic construct
  misc_feature 1..660: note = derived and/or modified sequence opt4 from Mepolizumab_LightChain1
  source 1..660: mol_type = other RNA
gacatcgtgatgacccagagccccgacagcctggccgtgagcctgggcgagagagccaccatcaactgcaagagcagccagagcctgctgaacagcggcaaccagaagaactacctggcctggtaccagcagaagcccggccagccccccaagctgctgatctacggcgccagcaccagagagagcggcgtgcccgacagattcagcggcagcggcagcggcaccgacttcaccctgaccatcagcagcctgcaggccgaggacgtggccgtgtactactgccagaacgtgcacagcttccccttcaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31133 - RNA, 1350 nt, synthetic construct
  misc_feature 1..1350: note = derived and/or modified sequence opt4 from Metelimumab_HeavyChain1
  source 1..1350: mol_type = other RNA
gaggtgcagctggtggagagcggcggcggcgtggtgcagcccggcagaagcctgagactgagctgcgccgccagcggcttcaccttcagcagctacggcatgcactgggtgagacaggcccccggcaaggagctggagtgggtggccgtgatcagctacgacggcagcatcaagtactacgccgacagcgtgaagggcagattcaccatcagcagagacaacagcaagaacaccctgtacctgcagatgaacagcctgagagccgaggacaccgccgtgtactactgcgccagaaccggcgagtacagcggctacgacaccgacccccagtacagctggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaagcccaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31134 - RNA, 639 nt, synthetic construct
  misc_feature 1..639: note = derived and/or modified sequence opt4 from Metelimumab_LightChain1
  source 1..639: mol_type = other RNA
gagatcgtgctgacccagagccccagcagcctgagcgccagcgtgggcgacagagtgaccatcacctgcagagccagccagggcatcggcgacgacctgggctggtaccagcagaagcccggcaaggcccccatcctgctgatctacggcaccagcaccctgcagagcggcgtgcccagcagattcagcggcagcggcagcggcaccgacttcaccctgaccatcaacagcctgcagcccgaggacttcgccacctactactgcctgcaggacagcaactaccccctgaccttcggcggcggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagccccgtgaccaagagcttcaacagaggcgagtgc

SEQ ID NO: 31135 - RNA, 1350 nt, synthetic construct
  misc_feature 1..1350: note = derived and/or modified sequence opt4 from Milatuzumab_HeavyChain1
  source 1..1350: mol_type = other RNA
caggtgcagctgcagcagagcggcagcgagctgaagaagcccggcgccagcgtgaaggtgagctgcaaggccagcggctacaccttcaccaactacggcgtgaactggatcaagcaggcccccggccagggcctgcagtggatgggctggatcaaccccaacaccggcgagcccaccttcgacgacgacttcaagggcagattcgccttcagcctggacaccagcgtgagcaccgcctacctgcagatcagcagcctgaaggccgacgacaccgccgtgtacttctgcagcagaagcagaggcaagaacgaggcctggttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31136 - RNA, 657 nt, synthetic construct
  misc_feature 1..657: note = derived and/or modified sequence opt4 from Milatuzumab_LightChain1
  source 1..657: mol_type = other RNA
gacatccagctgacccagagccccctgagcctgcccgtgaccctgggccagcccgccagcatcagctgcagaagcagccagagcctggtgcacagaaacggcaacacctacctgcactggttccagcagagacccggccagagccccagactgctgatctacaccgtgagcaacagattcagcggcgtgcccgacagattcagcggcagcggcagcggcaccgacttcaccctgaagatcagcagagtggaggccgaggacgtgggcgtgtacttctgcagccagagcagccacgtgccccccaccttcggcgccggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31137 - RNA, 1341 nt, synthetic construct
  misc_feature 1..1341: note = derived and/or modified sequence opt4 from Mirvetuximab_HeavyChain1
  source 1..1341: mol_type = other RNA
caggtgcagctggtgcagagcggcgccgaggtggtgaagcccggcgccagcgtgaagatcagctgcaaggccagcggctacaccttcaccggctacttcatgaactgggtgaagcagagccccggccagagcctggagtggatcggcagaatccacccctacgacggcgacaccttctacaaccagaagttccagggcaaggccaccctgaccgtggacaagagcagcaacaccgcccacatggagctgctgagcctgaccagcgaggacttcgccgtgtactactgcaccagatacgacggcagcagagccatggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31138 - RNA, 654 nt, synthetic construct
  misc_feature 1..654: note = derived and/or modified sequence opt4 from Mirvetuximab_LightChain1
  source 1..654: mol_type = other RNA
gacatcgtgctgacccagagccccctgagcctggccgtgagcctgggccagcccgccatcatcagctgcaaggccagccagagcgtgagcttcgccggcaccagcctgatgcactggtaccaccagaagcccggccagcagcccagactgctgatctacagagccagcaacctggaggccggcgtgcccgacagattcagcggcagcggcagcaagaccgacttcaccctgaccatcagccccgtggaggccgaggacgccgccacctactactgccagcagagcagagagtacccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31139 - RNA, 1344 nt, synthetic construct
  misc_feature 1..1344: note = derived and/or modified sequence opt4 from Modotuximab_HeavyChain1
  source 1..1344: mol_type = other RNA
caggtgcagctgcagcagcccggcgccgagctggtggagcccggcggcagcgtgaagctgagctgcaaggccagcggctacaccttcaccagccactggatgcactgggtgaagcagagacccggccagggcctggagtggatcggcgagatcaaccccagcagcggcagaaacaactacaacgagaagttcaagagcaaggccaccctgaccgtggacaagagcagcagcaccgcctacatgcagttcagcagcctgaccagcgaggacagcgccgtgtactactgcgtgagatactacggctacgacgaggccatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31140 - RNA, 657 nt, synthetic construct
  misc_feature 1..657: note = derived and/or modified sequence opt4 from Modotuximab_LightChain1
  source 1..657: mol_type = other RNA
gacatcgtgatgacccaggccgccttcagcaaccccgtgaccctgggcaccagcgccagcatcagctgcagaagcagcaagagcctgctgcacagcaacggcatcacctacctgtactggtacctgcagaagcccggccagagcccccagctgctgatctaccagatgagcaacctggccagcggcgtgcccgacagattcagcagcagcggcagcggcaccgacttcaccctgagaatcagcagagtggaggccgaggacgtgggcgtgtactactgcgcccagaacctggagctgccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31141 - RNA, 1347 nt, synthetic construct
  misc_feature 1..1347: note = derived and/or modified sequence opt4 from Mogamulizumab_HeavyChain1
  source 1..1347: mol_type = other RNA
gaggtgcagctggtggagagcggcggcgacctggtgcagcccggcagaagcctgagactgagctgcgccgccagcggcttcatcttcagcaactacggcatgagctgggtgagacaggcccccggcaagggcctggagtgggtggccaccatcagcagcgccagcacctacagctactaccccgacagcgtgaagggcagattcaccatcagcagagacaacgccaagaacagcctgtacctgcagatgaacagcctgagagtggaggacaccgccctgtactactgcggcagacacagcgacggcaacttcgccttcggctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31142 - RNA, 657 nt, synthetic construct
  misc_feature 1..657: note = derived and/or modified sequence opt4 from Mogamulizumab_LightChain1
  source 1..657: mol_type = other RNA
gacgtgctgatgacccagagccccctgagcctgcccgtgacccccggcgagcccgccagcatcagctgcagaagcagcagaaacatcgtgcacatcaacggcgacacctacctggagtggtacctgcagaagcccggccagagcccccagctgctgatctacaaggtgagcaacagattcagcggcgtgcccgacagattcagcggcagcggcagcggcaccgacttcaccctgaagatcagcagagtggaggccgaggacgtgggcgtgtactactgcttccagggcagcctgctgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31143 - RNA, 1356 nt, synthetic construct
  misc_feature 1..1356: note = derived and/or modified sequence opt4 from Monalizumab_HeavyChain1
  source 1..1356: mol_type = other RNA
caggtgcagctggtgcagagcggcgccgaggtgaagaagcccggcgccagcgtgaaggtgagctgcaaggccagcggctacaccttcaccagctactggatgaactgggtgagacaggcccccggccagggcctggagtggatgggcagaatcgacccctacgacagcgagacccactacgcccagaagctgcagggcagagtgaccatgaccaccgacaccagcaccagcaccgcctacatggagctgagaagcctgagaagcgacgacaccgccgtgtactactgcgccagaggcggctacgacttcgacgtgggcaccctgtactggttcttcgacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31144 - RNA, 642 nt, synthetic construct
  misc_feature 1..642: note = derived and/or modified sequence opt4 from Monalizumab_LightChain1
  source 1..642: mol_type = other RNA
gacatccagatgacccagagccccagcagcctgagcgccagcgtgggcgacagagtgaccatcacctgcagagccagcgagaacatctacagctacctggcctggtaccagcagaagcccggcaaggcccccaagctgctgatctacaacgccaagaccctggccgagggcgtgcccagcagattcagcggcagcggcagcggcaccgacttcaccctgaccatcagcagcctgcagcccgaggacttcgccacctactactgccagcaccactacggcacccccagaaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31145 - RNA, 1350 nt, synthetic construct
  misc_feature 1..1350: note = derived and/or modified sequence opt4 from Motavizumab_HeavyChain
  source 1..1350: mol_type = other RNA
caggtgaccctgagagagagcggccccgccctggtgaagcccacccagaccctgaccctgacctgcaccttcagcggcttcagcctgagcaccgccggcatgagcgtgggctggatcagacagccccccggcaaggccctggagtggctggccgacatctggtgggacgacaagaagcactacaaccccagcctgaaggacagactgaccatcagcaaggacaccagcaagaaccaggtggtgctgaaggtgaccaacatggaccccgccgacaccgccacctactactgcgccagagacatgatcttcaacttctacttcgacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31146 - RNA, 1350 nt, synthetic construct; identical to SEQ ID NO: 31145
  misc_feature 1..1350: note = derived and/or modified sequence opt4 from Motavizumab_HeavyChain_variant
  source 1..1350: mol_type = other RNA

SEQ ID NO: 31147 - RNA, 639 nt, synthetic construct
  misc_feature 1..639: note = derived and/or modified sequence opt4 from Motavizumab_LightChain
  source 1..639: mol_type = other RNA
gacatccagatgacccagagccccagcaccctgagcgccagcgtgggcgacagagtgaccatcacctgcagcgccagcagcagagtgggctacatgcactggtaccagcagaagcccggcaaggcccccaagctgctgatctacgacaccagcaagctggccagcggcgtgcccagcagattcagcggcagcggcagcggcaccgagttcaccctgaccatcagcagcctgcagcccgacgacttcgccacctactactgcttccagggcagcggctaccccttcaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31148 - RNA, 639 nt, synthetic construct; identical to SEQ ID NO: 31147
  misc_feature 1..639: note = derived and/or modified sequence opt4 from Motavizumab_LightChain_variant
  source 1..639: mol_type = other RNA

SEQ ID NO: 31149 - RNA, 1428 nt, synthetic construct
  misc_feature 1..1428: note = derived and/or modified sequence opt4 from Moxetumomab_pasudotox_HeavyChain1
  source 1..1428: mol_type = other RNA
atggaggtgcagctggtggagagcggcggcggcctggtgaagcccggcggcagcctgaagctgagctgcgccgccagcggcttcgccttcagcatctacgacatgagctgggtgagacagacccccgagaagtgcctggagtgggtggcctacatcagcagcggcggcggcaccacctactaccccgacaccgtgaagggcagattcaccatcagcagagacaacgccaagaacaccctgtacctgcagatgagcagcctgaagagcgaggacaccgccatgtactactgcgccagacacagcggctacggcacccactggggcgtgctgttcgcctactggggccagggcaccctggtgaccgtgagcgccaaggccagcggcggccccgagggcggcagcctggccgccctgaccgcccaccaggcctgccacctgcccctggagaccttcaccagacacagacagcccagaggctgggagcagctggagcagtgcggctaccccgtgcagagactggtggccctgtacctggccgccagactgagctggaaccaggtggaccaggtgatcagaaacgccctggccagccccggcagcggcggcgacctgggcgaggccatcagagagcagcccgagcaggccagactggccctgaccctggccgccgccgagagcgagagattcgtgagacagggcaccggcaacgacgaggccggcgccgccaacggccccgccgacagcggcgacgccctgctggagagaaactaccccaccggcgccgagttcctgggcgacggcggcgacgtgagcttcagcaccagaggcacccagaactggaccgtggagagactgctgcaggcccacagacagctggaggagagaggctacgtgttcgtgggctaccacggcaccttcctggaggccgcccagagcatcgtgttcggcggcgtgagagccagaagccaggacctggacgccatctggagaggcttctacatcgccggcgaccccgccctggcctacggctacgcccaggaccaggagcccgacgccagaggcagaatcagaaacggcgccctgctgagagtgtacgtgcccagaagcagcctgcccggcttctacagaaccagcctgaccctggccgcccccgaggccgccggcgaggtggagagactgatcggccaccccctgcccctgagactggacgccatcaccggccccgaggaggagggcggcagactggagaccatcctgggctggcccctggccgagagaaccgtggtgatccccagcgccatccccaccgaccccagaaacgtgggcggcgacctggaccccagcagcatccccgacaaggagcaggccatcagcgccctgcccgactacgccagccagcccggcaagccccccagagaggacctgaag

SEQ ID NO: 31150 - RNA, 324 nt, synthetic construct
  misc_feature 1..324: note = derived and/or modified sequence opt4 from Moxetumomab_pasudotox_LightChain1
  source 1..324: mol_type = other RNA
atggacatccagatgacccagaccaccagcagcctgagcgccagcctgggcgacagagtgaccatcagctgcagagccagccaggacatcagcaactacctgaactggtaccagcagaagcccgacggcaccgtgaagctgctgatctactacaccagcatcctgcacagcggcgtgcccagcagattcagcggcagcggcagcggcaccgactacagcctgaccatcagcaacctggagcaggaggacttcgccacctacttctgccagcagggcaacaccctgccctggaccttcggctgcggcaccaagctggagatcaag

SEQ ID NO: 31151 - RNA, 1350 nt, synthetic construct
  misc_feature 1..1350: note = derived and/or modified sequence opt4 from Muromonab-CD3_HeavyChain
  source 1..1350: mol_type = other RNA
caggtgcagctgcagcagagcggcgccgagctggccagacccggcgccagcgtgaagatgagctgcaaggccagcggctacaccttcaccagatacaccatgcactgggtgaagcagagacccggccagggcctggagtggatcggctacatcaaccccagcagaggctacaccaactacaaccagaagttcaaggacaaggccaccctgaccaccgacaagagcagcagcaccgcctacatgcagctgagcagcctgaccagcgaggacagcgccgtgtactactgcgccagatactacgacgaccactactgcctggactactggggccagggcaccaccctgaccgtgagcagcgccaagaccaccgcccccagcgtgtaccccctggcccccgtgtgcggcggcaccaccggcagcagcgtgaccctgggctgcctggtgaagggctacttccccgagcccgtgaccctgacctggaacagcggcagcctgagcagcggcgtgcacaccttccccgccgtgctgcagagcgacctgtacaccctgagcagcagcgtgaccgtgaccagcagcacctggcccagccagagcatcacctgcaacgtggcccaccccgccagcagcaccaaggtggacaagaagatcgagcccagacccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31152 - RNA, 639 nt, synthetic construct
  misc_feature 1..639: note = derived and/or modified sequence opt4 from Muromonab-CD3_LightChain
  source 1..639: mol_type = other RNA
cagatcgtgctgacccagagccccgccatcatgagcgccagccccggcgagaaggtgaccatgacctgcagcgccagcagcagcgtgagctacatgaactggtaccagcagaagagcggcaccagccccaagagatggatctacgacaccagcaagctggccagcggcgtgcccgcccacttcagaggcagcggcagcggcaccagctacagcctgaccatcagcggcatggaggccgaggacgccgccacctactactgccagcagtggagcagcaaccccttcaccttcggcagcggcaccaagctggagatcaacagagccgacaccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 31153 - RNA, 1347 nt, synthetic construct
  misc_feature 1..1347: note = derived and/or modified sequence opt4 from Namilumab_HeavyChain1
  source 1..1347: mol_type = other RNA
caggtgcagctggtgcagagcggcgccgaggtgaagaagcccggcgccagcgtgaaggtgagctgcaaggccttcggctaccccttcaccgactacctgctgcactgggtgagacaggcccccggccagggcctggagtgggtgggctggctgaacccctacagcggcgacaccaactacgcccagaagttccagggcagagtgaccatgaccagagacaccagcatcagcaccgcctacatggagctgagcagactgagaagcgacgacaccgccgtgtactactgcaccagaaccaccctgatcagcgtgtacttcgactactggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31154 - RNA, 642 nt, synthetic construct
  misc_feature 1..642: note = derived and/or modified sequence opt4 from Namilumab_LightChain1
  source 1..642: mol_type = other RNA
gacatccagatgacccagagccccagcagcgtgagcgccagcgtgggcgacagagtgaccatcgcctgcagagccagccagaacatcagaaacatcctgaactggtaccagcagagacccggcaaggccccccagctgctgatctacgccgccagcaacctgcagagcggcgtgcccagcagattcagcggcagcggcagcggcaccgacttcaccctgaccatcaacagcctgcagcccgaggacttcgccacctactactgccagcagagctacagcatgcccagaaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31155 - RNA, 1374 nt, synthetic construct
  misc_feature 1..1374: note = derived and/or modified sequence opt4 from Naptumomab_estafenatox_HeavyChain
  source 1..1374: mol_type = other RNA
gaggtgcagctgcagcagagcggccccgacctggtgaagcccggcgccagcgtgaagatcagctgcaaggccagcggctacagcttcaccggctactacatgcactgggtgaagcagagccccggcaagggcctggagtggatcggcagaatcaaccccaacaacggcgtgaccctgtacaaccagaagttcaaggacaaggccaccctgaccgtggacaagagcagcaccaccgcctacatggagctgagaagcctgaccagcgaggacagcgccgtgtactactgcgccagaagcaccatgatcaccaactacgtgatggactactggggccagggcaccagcgtgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagacagcggcggccccagcgagaagagcgaggagatcaacgagaaggacctgagaaagaagagcgagctgcagggcaccgccctgggcaacctgaagcagatctactactacaacagcaaggccatcaccagcagcgagaagagcgccgaccagttcctgaccaacaccctgctgttcaagggcttcttcaccggccacccctggtacaacgacctgctggtggacctgggcagcaccgccgccaccagcgagtacgagggcagcagcgtggacctgtacggcgcctactacggctaccagtgcgccggcggcacccccaacaagaccgcctgcatgtacggcggcgtgaccctgcacgacaacaacagactgaccgaggagaagaaggtgcccatcaacctgtggatcgacggcaagcagaccaccgtgcccatcgacaaggtgaagaccagcaagaaggaggtgaccgtgcaggagctggacctgcaggccagacactacctgcacggcaagttcggcctgtacaacagcgacagcttcggcggcaaggtgcagagaggcctgatcgtgttccacagcagcgagggcagcaccgtgagctacgacctgttcgacgcccagggccagtaccccgacaccctgctgagaatctacagagacaacaccaccatcagcagcaccagcctgagcatcagcctgtacctgtacaccacc

SEQ ID NO: 31156 - RNA, 642 nt, synthetic construct
  misc_feature 1..642: note = derived and/or modified sequence opt4 from Naptumomab_estafenatox_LightChain
  source 1..642: mol_type = other RNA
agcatcgtgatgacccagacccccaccagcctgctggtgagcgccggcgacagagtgaccatcacctgcaaggccagccagagcgtgagcaacgacgtggcctggtaccagcagaagcccggccagagccccaagctgctgatcagctacaccagcagcagatacgccggcgtgcccgacagattcagcggcagcggctacggcaccgacttcaccctgaccatcagcagcgtgcaggccgaggacgccgccgtgtacttctgccagcaggactacaacagcccccccaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagagc

SEQ ID NO: 31157 - RNA, 1356 nt, synthetic construct
  misc_feature 1..1356: note = derived and/or modified sequence opt4 from Narnatumab_HeavyChain1
  source 1..1356: mol_type = other RNA
gaggtgcagctggtggagagcggcggcggcctggtgcagcccggcggcagcctgagactgagctgcgccgccagcggcttcaccttcagcagctacctgatgacctgggtgagacaggcccccggcaagggcctggagtgggtggccaacatcaagcaggacggcagcgagaagtactacgtggacagcgtgaagggcagattcaccatcagcagagacaacgccaagaacagcctgaacctgcagatgaacagcctgagagccgaggacaccgccgtgtactactgcaccagagacggctacagcagcggcagacactacggcatggacgtgtggggccagggcaccaccgtgatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31158 - RNA, 642 nt, synthetic construct
  misc_feature 1..642: note = derived and/or modified sequence opt4 from Narnatumab_LightChain1
  source 1..642: mol_type = other RNA
gagatcgtgctgacccagagccccgccaccctgagcctgagccccggcgagagagccaccctgagctgcagagccagccagagcgtgagcagatacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31159 - RNA, 1350 nt, synthetic construct
  misc_feature 1..1350: note = derived and/or modified sequence opt4 from Natalizumab_HeavyChain1
  source 1..1350: mol_type = other RNA
caggtgcagctggtgcagagcggcgccgaggtgaagaagcccggcgccagcgtgaaggtgagctgcaaggccagcggcttcaacatcaaggacacctacatccactgggtgagacaggcccccggccagagactggagtggatgggcagaatcgaccccgccaacggctacaccaagtacgaccccaagttccagggcagagtgaccatcaccgccgacaccagcgccagcaccgcctacatggagctgagcagcctgagaagcgaggacaccgccgtgtactactgcgccagagagggctactacggcaactacggcgtgtacgccatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31160 - RNA, 639 nt, synthetic construct
  misc_feature 1..639: note = derived and/or modified sequence opt4 from Natalizumab_LightChain1
  source 1..639: mol_type = other RNA
gacatccagatgacccagagccccagcagcctgagcgccagcgtgggcgacagagtgaccatcacctgcaagaccagccaggacatcaacaagtacatggcctggtaccagcagacccccggcaaggcccccagactgctgatccactacaccagcgccctgcagcccggcatccccagcagattcagcggcagcggcagcggcagagactacaccttcaccatcagcagcctgcagcccgaggacatcgccacctactactgcctgcagtacgacaacctgtggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31161 - RNA, 1335 nt, synthetic construct
  misc_feature 1..1335: note = derived and/or modified sequence opt4 from Navicixizumab_HeavyChain1
  source 1..1335: mol_type = other RNA
caggtgcagctggtgcagagcggcgccgaggtgaagaagcccggcgccagcgtgaagatcagctgcaaggccagcggctacagcttcaccgcctactacatccactgggtgaagcaggcccccggccagggcctggagtggatcggctacatcagcaactacaacagagccaccaactacaaccagaagttcaagggcagagtgaccttcaccaccgacaccagcaccagcaccgcctacatggagctgagaagcctgagaagcgacgacaccgccgtgtactactgcgccagagactacgactacgacgtgggcatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtggagggcttctaccccagcgacatcgccgtggagtgggagagcaacggccagcccgagaacaactacaagaccaccccccccatgctggacagcgacggcagcttcttcctgtacagcgagctgaccgtggacaagagcagatggcagcagggcaacgtgttcagctgcagcgtgatgcacgaggccctgcacaaccactacacccagaagagcctgagcctgagccccggcaag

SEQ ID NO: 31162 - RNA, 1341 nt, synthetic construct
  misc_feature 1..1341: note = derived and/or modified sequence opt4 from Navicixizumab_HeavyChain2
  source 1..1341: mol_type = other RNA
caggtgcagctggtgcagagcggcgccgaggtgaagaagcccggcgccagcgtgaaggtgagctgcaaggccagcggctacaccttcaccaactactggatgcactgggtgagacaggcccccggccagggcctggagtggatgggcgacatcaaccccagcaacggcagaaccagctacaaggagaagttcaagagaagagtgaccctgagcgtggacaagagcagcagcaccgcctacatggagctgagcagcctgagaagcgaggacaccgccgtgtacttctgcaccatccactacgacgacaagtactaccccctgatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagagaagatgaccaagaaccaggtgagcctgacctgcctggtgaagggcttctaccccagcgacatcgccgtggagtgggagagcaacggccagcccgagaacaactacaagaccaccccccccatgctgaagagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31163 - RNA, 654 nt, synthetic construct; identical to SEQ ID NO: 30767
  misc_feature 1..654: note = derived and/or modified sequence opt4 from Navicixizumab_LightChain1
  source 1..654: mol_type = other RNA

SEQ ID NO: 31164 - RNA, 1368 nt, synthetic construct
  misc_feature 1..1368: note = derived and/or modified sequence opt4 from Navivumab_HeavyChain1
  source 1..1368: mol_type = other RNA
caggtgcagctggtgcagagcggcgccgaggtgaagaagcccggcgccagcgtgaaggtgagctgcaagaccagcggctacagcttcagcacctacggcgtgagctgggtgagacaggcccccggccagggccccgagtgggtgggctggatcagcgcctacaccggcatcaccgactacgcccagaagttccagggcagagtgaccctgaccaccgacgccaccaccgccaccgccttcctggacctgagaagcctgagacccgacgacaccgccacctacttctgcgccagagacaaggtgcagggcagagtggaggtgggcagcggcggcagacacgactactggggccagggcaccctggtgatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 31165 - RNA, 645 nt, synthetic construct
  misc_feature 1..645: note = derived and/or modified sequence opt4 from Navivumab_LightChain1
  source 1..645: mol_type = other RNA
gaggtggtgctgacccagagccccggcaccctggccctgccccccggcgagagagccaccctgagctgcagagccagccacagagtgggcagcacctacatcgcctggtaccagcagaagagcggccaggcccccagaagactgatctacggcgccagcaacagagccaccgacatccccgacagattcagcggcagcggcagcggcaccgacttcaccctgaccatcagaagactggagcccgaggacagcgccgtgtactactgccagcagttcagcgtgagcccctggaccttcggccagggcaccagagtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31166 - RNA, 2172 nt, synthetic construct
  misc_feature 1..2172: note = derived and/or modified sequence opt4 from Ndimab-varB_HeavyChain
  source 1..2172: mol_type = other RNA
caggtgcagctggtggagagcggcggcggcgtggtgcagcccggcagaagcctgagactgagctgcgccgccagcggcttcatcttcagcagctacgccatgcactgggtgagacaggcccccggcaacggcctggagtgggtggccttcatgagctacgacggcagcaacaagaagtacgccgacagcgtgaagggcagattcaccatcagcagagacaacagcaagaacaccctgtacctgcagatgaacagcctgagagccgaggacaccgccgtgtactactgcgccagagacagaggcatcagcgccggcggcaactactactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagggcggcggcggcagcggcggcggcggcagccaggtgcagctggtgcagagcggcgccgaggtgaagaagcccggcagcagcgtgaaggtgagctgcaaggccagcggcggcaccttcagcacctacggcatcagctgggtgagacaggcccccggccagtgcctggagtggatgggcggcatcatccccatcttcgacaccggcaacagcgcccagagcttccagggcagagtgaccatcaccgccgacgagagcaccagcaccgcctacatggagctgagcagcctgagaagcgaggacaccgccgtgtactactgcgccagaagcagcagaatctacgacctgaaccccagcctgaccgcctactacgacatggacgtgtggggccagggcaccatggtgaccgtgagcagcggcggcggcggcagcggcggcggcggcagcggcggcggcggcagcggcggcggcggcagccagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagcagcctgagcgcctgggtgttcggctgcggcaccaagctgaccgtgctg

SEQ ID NO: 31167 - RNA, 645 nt, synthetic construct
  misc_feature 1..645: note = derived and/or modified sequence opt4 from Ndimab-varB_LightChain
  source 1..645: mol_type = other RNA
gagatcgtgctgacccagagccccgccaccctgagcctgagccccggcgagagagccaccctgagctgcagagccagccagagcgtgtacagctacctggcctggtaccagcagaagcccggccaggcccccagactgctgatctacgacgccagcaacagagccatcggcatccccgccagattcagcggcagcggcagcggcaccgacttcaccctgaccatcagcagcctggagcccgaggacttcgccgtgtactactgccagcagagaagcaactggccccccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31168 - RNA, 1353 nt, synthetic construct
  misc_feature 1..1353: note = derived and/or modified sequence opt4 from Necitumumab_HeavyChain1
  source 1..1353: mol_type = other RNA
caggtgcagctgcaggagagcggccccggcctggtgaagcccagccagaccctgagcctgacctgcaccgtgagcggcggcagcatcagcagcggcgactactactggagctggatcagacagccccccggcaagggcctggagtggatcggctacatctactacagcggcagcaccgactacaaccccagcctgaagagcagagtgaccatgagcgtggacaccagcaagaaccagttcagcctgaaggtgaacagcgtgaccgccgccgacaccgccgtgtactactgcgccagagtgagcatcttcggcgtgggcaccttcgactactggggccagggcaccctggtgaccgtgagcagcgccagcaccaagggccccagcgtgctgcccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31169 - RNA, 642 nt, synthetic construct
  misc_feature 1..642: note = derived and/or modified sequence opt4 from Necitumumab_LightChain1
  source 1..642: mol_type = other RNA
gagatcgtgatgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccaccagtacggcagcacccccctgaccttcggcggcggcaccaaggccgagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31170 - RNA, 396 nt, synthetic construct
  misc_feature 1..396: note = derived and/or modified sequence opt4 from Neliximab_HeavyChain_VH-Region
  source 1..396: mol_type = other RNA
gaggtgcagctgcagcagagcggccccgagctggtgaagcccggcgccagcgtgaagatgagctgcaaggccagcggctacaccttcaccacctacgtgatgcactgggtgaagcagaagcccggccagggcctggagtggatcggctacatcaacccctacaacgacggcaccaactacaacgagaagttcaagggcaaggccaccctgaccagcgacaagagcagcagcaccgcctacatggagctgagcaccctgaccagcgaggacagcgccgtgtactactgcgccgagttcatcaccaagaccgtgggcggcagcaactggtacctggacgtgtggggcgccggcaccaccgtgaccgtgagcagcgccaagaccaccccccccaagctg

SEQ ID NO: 31171 - RNA, 372 nt, synthetic construct
  misc_feature 1..372: note = derived and/or modified sequence opt4 from Neliximab_HeavyChain_VH-Region_variant1
  source 1..372: mol_type = other RNA
caggtgcagctgaagcagagcggccccgagctggtgaagcccggcgccagcgtgaagatgagctgcaaggccagcggctacaccttcaccacctacgtgatgcactgggtgaagcagaagcccggccagggcctggagtggatcggctacatcaacccctacaacgacggcaccaactacaacgagaagttcaagggcaaggccaccctgaccagcgacaagagcagcagcaccgcctacatggagctgagcaccctgaccagcgaggacagcgccgtgtactactgcgccgagttcatcaccaagaccgtgggcggcagcaactggtacctggacgtgtggggcgccggcaccaccgtgaccgtgagcagc

SEQ ID NO: 31172 - RNA, 318 nt, synthetic construct
  misc_feature 1..318: note = derived and/or modified sequence opt4 from Neliximab_LightChain_VL-Region
  source 1..318: mol_type = other RNA
gacatcgtgctgacccagagccccgccatcatgagcgccagccccggcgagaaggtgaccatgacctgcagcgccagcagcagcatcagctacatccactggttccagcagaagcccggcaccagccccaagagatggatctacgacaccagcaagctgcccagcggcgtgcccgccagattcagcggcagcggcagcggcaccagctacagcctgaccatcagcagcatggaggccgaggacgccgccacctactactgccaccagagaagcagctacacctggaccttcggcggcggcaccaagctggagatcaag

SEQ ID NO: 31173 - RNA, 354 nt, synthetic construct
  misc_feature 1..354: note = derived and/or modified sequence opt4 from Neliximab_LightChain_VL-Region_variant1
  source 1..354: mol_type = other RNA
cagatcgtgctgacccagagccccgccatcatgagcgccagccccggcgagaaggtgaccatgacctgcagcgccagcagcagcatcagctacatccactggttccagcagaagcccggcaccagccccaagagatggatctacgacaccagcaagctgcccagcggcgtgcccgccagattcagcggcagcggcagcggcaccagctacagcctgaccatcagcagcatggaggccgaggacgccgccacctactactgccaccagagaagcagctacacctggaccttcggcggcggcaccaagctggagatcaagagagccgacgccgcccccaccgtgagcgccgccgcc

SEQ ID NO: 31174 - RNA, 1335 nt, synthetic construct
  misc_feature 1..1335: note = derived and/or modified sequence opt4 from Nemolizumab_HeavyChain1
  source 1..1335: mol_type = other RNA
caggtgcagctggtgcagagcggcgccgaggtgaagaagcccggcgccagcgtgaaggtgagctgcaaggccagcggctacaccttcaccggctacatcatgaactgggtgagacaggcccccggccagggcctggagtggatgggcctgatcaacccctacaacggcggcaccgactacaacccccagttccaggacagagtgaccatcaccgccgacaagagcaccagcaccgcctacatggagctgagcagcctgagaagcgaggacaccgccgtgtactactgcgccagagacggctacgacgacggcccctacaccctggagacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagagctgcgtggagtgccccccctgccccgccccccccgtggccggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcaggagggcaacgtgttcagctgcagcgtgatgcacgaggccctgcacaaccactacacccagaagagcctgagcctgagcccc

SEQ ID NO: 31175 - RNA, 642 nt, synthetic construct
  misc_feature 1..642: note = derived and/or modified sequence opt4 from Nemolizumab_LightChain1
  source 1..642: mol_type = other RNA
gacatccagatgacccagagccccagcagcctgagcgccagcgtgggcgacagagtgaccatcacctgccaggccagcgaggacatctacagcttcgtggcctggtaccagcagaagcccggcaaggcccccaagctgctgatctacaacgcccagaccgaggcccagggcgtgcccagcagattcagcggcagcggcagcggcaccgacttcaccctgaccatcagcagcctgcagcccgaggacttcgccacctactactgccagcaccactacgacagccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31176 - RNA, 1356 nt, synthetic construct
  misc_feature 1..1356: note = derived and/or modified sequence opt4 from Nesvacumab_HeavyChain1
  source 1..1356: mol_type = other RNA
gaggtgcagctggtggagagcggcggcggcctggtgcagcccggcggcagcctgagactgagctgcgccgccagcggcttcaccttcagcagctacgacatccactgggtgagacaggccaccggcaagggcctggagtgggtgagcgccatcggccccgccggcgacacctactaccccggcagcgtgaagggcagattcaccatcagcagagagaacgccaagaacagcctgtacctgcagatgaacagcctgagagccggcgacaccgccgtgtactactgcgccagaggcctgatcaccttcggcggcctgatcgcccccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31177 - RNA, 642 nt, synthetic construct
  misc_feature 1..642: note = derived and/or modified sequence opt4 from Nesvacumab_LightChain1
  source 1..642: mol_type = other RNA
gagatcgtgctgacccagagccccggcaccctgagcctgagccccggcgagagagccaccctgagctgcagagccagccagagcgtgagcagcacctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcactacgacaacagccagaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31178 - RNA, 1362 nt, synthetic construct
  misc_feature 1..1362: note = derived and/or modified sequence opt4 from Neuradiab_HeavyChain1
  source 1..1362: mol_type = other RNA
gaggtgcagctgcagcagagcggccccgagctggtgaagcccggcgccagcgtgaagatgagctgcaaggccagcggctacaccttcaccagctacgtggtgcactgggtgaagcagaaccccggccagggcctggagtggatcggctacatcaaccccttcaacgacggcaccaagtacaacgagaacttcaagtgcaaggccaccctgaccagcgacagaagcagcagcaccgcctacatggagctgagcagcctgaccagcgaggagagcgccgtgtacttctgcgccagagacatgggcagagagggcttcgcctactggggccagggcaccctggtgaccgtgagcgccgccaagaccaccccccccagcgtgtaccccctggcccccggctgcggcgacaccaccggcagcagcgtgaccctgggctgcctggtgaagggctacttccccgagagcgtgaccgtgacctggaacagcggcagcctgagcagcagcgtgcacaccttccccgccctgctgcagagcggcctgtacaccatgagcagcagcgtgaccgtgcccagcagcacctggcccagccagatcgtgatctgcagcgtggcccaccccgccagcagcaccaccgtggacaagaagctggagcccagcggccccatcagcaccatcaacccctgccccccctgcaaggagtgccacaagtgccccgcccccaacctggagggcggccccagcgtgttcatcttcccccccaacatcaaggacgtgctgatgatcagcctgacccccaaggtgacctgcgtggtggtggacgtgagcgaggacgaccccgacgtgcagatcagctggttcgtgaacaacgtggaggtgcacaccgcccagacccagacccacagagaggactacaacagcaccatcagagtggtgagcaccctgcccatccagcaccaggactggatgagcggcaaggagttcaagtgcaaggtgaacaacaaggacctgcccagccccatcgagagaaccatcagcaagatcaagggcctggtgagagccccccaggtgtacatcctgcccccccccgccgagcagctgagcagaaaggacgtgagcctgacctgcctggtggtgggcttcaaccccggcgacatcagcgtggagtggaccagcaacggccacaccgaggagaactacaaggacaccgcccccgtgctggacagcgacggcagctacttcatctacagcaagctgaacatgaagaccagcaagtgggagaagaccgacagcttcagctgcaacgtgagacacgagggcctgaagaactactacctgaagaagaccatcagcagaagccccggcaag

SEQ ID NO: 31179 - RNA, 657 nt, synthetic construct
  misc_feature 1..657: note = derived and/or modified sequence opt4 from Neuradiab_LightChain1
  source 1..657: mol_type = other RNA
gacatcgtgatgacccaggccgccttcagcaaccccgtgaccctgggcaccagcgccagcatcagctgcagaagcagcaagagcctgctgcacagcaacggcatcacctacctgtactggtacctgcagaagcccggccagagcccccagctgctgatctaccagatgagcaacctggccagcggcgtgcccgacagattcagcagcagcggcagcggcaccgacttcaccctgagaatcagcagagtggaggccgaggacgtgggcgtgtactactgcgcccagaacctggagctgcccagaaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 31180 - RNA, 369 nt, synthetic construct
  misc_feature 1..369: note = derived and/or modified sequence opt4 from Nimotuzumab_HeavyChain1
  source 1..369: mol_type = other RNA
caggtgcagctgcagcagagcggcgccgaggtgaagaagcccggcagcagcgtgaaggtgagctgcaaggccagcggctacaccttcaccaactactacatctactgggtgagacaggcccccggccagggcctggagtggatcggcggcatcaaccccaccagcggcggcagcaacttcaacgagaagttcaagaccagagtgaccatcaccgtggacgagagcaccaacaccgcctacatggagctgagcagcctgagaagcgaggacaccgccttctacttctgcgccagacagggcctgtggttcgacagcgacggcagaggcttcgacttctggggccagggcagcaccgtgaccgtgagcagc

SEQ ID NO: 31181 - RNA, 342 nt, synthetic construct
  misc_feature 1..342: note = derived and/or modified sequence opt4 from Nimotuzumab_LightChain1
  source 1..342: mol_type = other RNA
gacatccagatgacccagagccccagcagcctgagcgccagcgtgggcgacagagtgaccatcacctgcagaagcagccagaacatcgtgcacagcaacggcaacacctacctggactggtaccagcagacccccggcaaggcccccaagctgctgatctacaaggtgagcaacagattcagcggcgtgcccagcagattcagcggcagcggcagcggcaccgacttcaccttcaccatcagcagcctgcagcccgaggacatcgccacctactactgcttccagtacagccacgtgccctggaccttcggccagggcaccaagctgcagatcaccagagag

SEQ ID NO: 31182 - RNA, 1320 nt, synthetic construct
  misc_feature 1..1320: note = derived and/or modified sequence opt4 from Nivolumab_HeavyChain1
  source 1..1320: mol_type = other RNA
caggtgcagctggtggagagcggcggcggcgtggtgcagcccggcagaagcctgagactggactgcaaggccagcggcatcaccttcagcaacagcggcatgcactgggtgagacaggcccccggcaagggcctggagtgggtggccgtgatctggtacgacggcagcaagagatactacgccgacagcgtgaagggcagattcaccatcagcagagacaacagcaagaacaccctgttcctgcagatgaacagcctgagagccgaggacaccgccgtgtactactgcgccaccaacgacgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31183 - RNA, 642 nt, synthetic construct
  misc_feature 1..642: note = derived and/or modified sequence opt4 from Nivolumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagcagcaactggcccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31184 - RNA, 1347 nt, synthetic construct
  misc_feature 1..1347: note = derived and/or modified sequence opt4 from Obiltoxaximab_HeavyChain1
  source 1..1347: mol_type = other RNA
caggtgcagctgcagcagagcggccccgagctgaagaagcccggcgccagcgtgaaggtgagctgcaaggacagcggctacgccttcagcagcagctggatgaactgggtgagacaggcccccggccagggcctggagtggatcggcagaatctaccccggcgacggcgacaccaactacaacggcaagttccagggcagagtgaccatcaccgccgacaagagcagcagcaccgcctacatggagctgagcagcctgagaagcgaggacaccgccgtgtacttctgcgccagaagcggcctgctgagatacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31185 - RNA, 642 nt, synthetic construct
  misc_feature 1..642: note = derived and/or modified sequence opt4 from Obiltoxaximab_LightChain1
  source 1..642: mol_type = other RNA
gacatccagatgacccagagccccagcagcctgagcgccagcgtgggcgacagagtgaccatcacctgcagagccagccaggacatcagaaactacctgaactggtaccagcagaagcccggcaaggccgtgaagctgctgatctactacaccagcagactgctgcccggcgtgcccagcagattcagcggcagcggcagcggcaccgactacagcctgaccatcagcagccaggagcaggaggacatcggcacctacttctgccagcagggcaacaccctgccctggaccttcggccagggcaccaaggtggagatcagaagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31186 - RNA, 1347 nt, synthetic construct; identical to SEQ ID NO: 30590
  misc_feature 1..1347: note = derived and/or modified sequence opt4 from Obinutuzumab_HeavyChain1
  source 1..1347: mol_type = other RNA

SEQ ID NO: 31187 - RNA, 657 nt, synthetic construct; identical to SEQ ID NO: 30591
  misc_feature 1..657: note = derived and/or modified sequence opt4 from Obinutuzumab_LightChain1
  source 1..657: mol_type = other RNA

SEQ ID NO: 31188 - RNA, 1350 nt, synthetic construct
  misc_feature 1..1350: note = derived and/or modified sequence opt4 from Ocaratuzumab_HeavyChain1
  source 1..1350: mol_type = other RNA
gaggtgcagctggtgcagagcggcgccgaggtgaagaagcccggcgagagcctgaagatcagctgcaagggcagcggcagaaccttcaccagctacaacatgcactgggtgagacagatgcccggcaagggcctggagtggatgggcgccatctaccccctgaccggcgacaccagctacaaccagaagagcaagctgcaggtgaccatcagcgccgacaagagcatcagcaccgcctacctgcagtggagcagcctgaaggccagcgacaccgccatgtactactgcgccagaagcacctacgtgggcggcgactggcagttcgacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagatcaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaagcagaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31189 - RNA, 639 nt, synthetic construct
  misc_feature 1..639: note = derived and/or modified sequence opt4 from Ocaratuzumab_LightChain1
  source 1..639: mol_type = other RNA
gagatcgtgctgacccagagccccggcaccctgagcctgagccccggcgagagagccaccctgagctgcagagccagcagcagcgtgccctacatccactggtaccagcagaagcccggccaggcccccagactgctgatctacgccaccagcgccctggccagcggcatccccgacagattcagcggcagcggcagcggcaccgacttcaccctgaccatcagcagactggagcccgaggacttcgccgtgtactactgccagcagtggctgagcaacccccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31190 - RNA, 1356 nt, synthetic construct
  misc_feature 1..1356: note = derived and/or modified sequence opt4 from Ocrelizumab_HeavyChain1
  source 1..1356: mol_type = other RNA
gaggtgcagctggtggagagcggcggcggcctggtgcagcccggcggcagcctgagactgagctgcgccgccagcggctacaccttcaccagctacaacatgcactgggtgagacaggcccccggcaagggcctggagtgggtgggcgccatctaccccggcaacggcgacaccagctacaaccagaagttcaagggcagattcaccatcagcgtggacaagagcaagaacaccctgtacctgcagatgaacagcctgagagccgaggacaccgccgtgtactactgcgccagagtggtgtactacagcaacagctactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31191 - RNA, 639 nt, synthetic construct
  misc_feature 1..639: note = derived and/or modified sequence opt4 from Ocrelizumab_LightChain1
  source 1..639: mol_type = other RNA
gacatccagatgacccagagccccagcagcctgagcgccagcgtgggcgacagagtgaccatcacctgcagagccagcagcagcgtgagctacatgcactggtaccagcagaagcccggcaaggcccccaagcccctgatctacgcccccagcaacctggccagcggcgtgcccagcagattcagcggcagcggcagcggcaccgacttcaccctgaccatcagcagcctgcagcccgaggacttcgccacctactactgccagcagtggagcttcaacccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31192 - RNA, 1356 nt, synthetic construct
  misc_feature 1..1356: note = derived and/or modified sequence opt4 from Ofatumumab_HeavyChain1
  source 1..1356: mol_type = other RNA
gaggtgcagctggtggagagcggcggcggcctggtgcagcccggcagaagcctgagactgagctgcgccgccagcggcttcaccttcaacgactacgccatgcactgggtgagacaggcccccggcaagggcctggagtgggtgagcaccatcagctggaacagcggcagcatcggctacgccgacagcgtgaagggcagattcaccatcagcagagacaacgccaagaagagcctgtacctgcagatgaacagcctgagagccgaggacaccgccctgtactactgcgccaaggacatccagtacggcaactactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31193 - RNA, 642 nt, synthetic construct
  misc_feature 1..642: note = derived and/or modified sequence opt4 from Ofatumumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccatcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31194 - RNA, 1371 nt, synthetic construct
  misc_feature 1..1371: note = derived and/or modified sequence opt4 from Olaratumab_HeavyChain1
  source 1..1371: mol_type = other RNA
cagctgcagctgcaggagagcggccccggcctggtgaagcccagcgagaccctgagcctgacctgcaccgtgagcggcggcagcatcaacagcagcagctactactggggctggctgagacagagccccggcaagggcctggagtggatcggcagcttcttctacaccggcagcacctactacaaccccagcctgagaagcagactgaccatcagcgtggacaccagcaagaaccagttcagcctgatgctgagcagcgtgaccgccgccgacaccgccgtgtactactgcgccagacagagcacctactactacggcagcggcaactactacggctggttcgacagatgggaccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31195 - RNA, 642 nt, synthetic construct
  misc_feature 1..642: note = derived and/or modified sequence opt4 from Olaratumab_LightChain1
  source 1..642: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccgccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31196 - RNA, 1341 nt, synthetic construct
  misc_feature 1..1341: note = derived and/or modified sequence opt4 from Olizuab_HeavyChain1
  source 1..1341: mol_type = other RNA
gaggtgcagctggtggagagcggcggcggcctggtgcagcccggcggcagcctgagactgagctgcgccgtgagcggctacagcatcaccagcggctacagctggaactggatcagacaggcccccggcaagggcctggagtgggtggccagcatcacctacgacggcagcaccaactacaaccccagcgtgaagggcagaatcaccatcagcagagacgacagcaagaacaccttctacctgcagaacagcctgagagccgaggacaccgccgtgtactactgcgccagaggcagccactacttcggccactggcacttcgccgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 31197 - RNA, 651 nt, synthetic construct
  misc_feature 1..651: note = derived and/or modified sequence opt4 from Olizuab_LightChain1
  source 1..651: mol_type = other RNA
gacatccagctgacccagagccccagcagcctgagcgccagcgtgggcgacagagtgaccatcacctgcagagccagccagagcgtggactacgacggcgacagctacaactggtaccagcagaagcccggcaaggcccccaagctgctgatctacgccgccagctacctggagagcggcgtgcccagcagattcagcggcagcggcagcggcaccgacttcaccctgaccatcagcagcctgcagcccgaggacttcgccacctactactgccagcagagccacgaggacccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31198 - RNA, 1341 nt, synthetic construct
  misc_feature 1..1341: note = derived and/or modified sequence opt4 from Olokizumab_HeavyChain1
  source 1..1341: mol_type = other RNA
gaggtgcagctggtggagagcggcggcggcctggtgcagcccggcggcagcctgagactgagctgcgccgccagcggcttcaacttcaacgactacttcatgaactgggtgagacaggcccccggcaagggcctggagtgggtggcccagatgagaaacaagaactaccagtacggcacctactacgccgagagcctggagggcagattcaccatcagcagagacgacagcaagaacagcctgtacctgcagatgaacagcctgaagaccgaggacaccgccgtgtactactgcgccagagagagctactacggcttcaccagctactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31199 - RNA, 642 nt, synthetic construct
  misc_feature 1..642: note = derived and/or modified sequence opt4 from Olokizumab_LightChain1
  source 1..642: mol_type = other RNA
gacatccagatgacccagagccccagcagcctgagcgccagcgtgggcgacagagtgaccatcacctgccaggccagccaggacatcggcatcagcctgagctggtaccagcagaagcccggcaaggcccccaagctgctgatctacaacgccaacaacctggccgacggcgtgcccagcagattcagcggcagcggcagcggcaccgacttcaccctgaccatcagcagcctgcagcccgaggacttcgccacctactactgcctgcagcacaacagcgccccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31200 - RNA, 1341 nt, synthetic construct
  misc_feature 1..1341: note = derived and/or modified sequence opt4 from Omalizumab_HeavyChain
  source 1..1341: mol_type = other RNA
gaggtgcagctggtggagagcggcggcggcctggtgcagcccggcggcagcctgagactgagctgcgccgtgagcggctacagcatcaccagcggctacagctggaactggatcagacaggcccccggcaagggcctggagtgggtggccagcatcacctacgacggcagcaccaactacgccgacagcgtgaagggcagattcaccatcagcagagacgacagcaagaacaccttctacctgcagatgaacagcctgagagccgaggacaccgccgtgtactactgcgccagaggcagccactacttcggccactggcacttcgccgtgtggggccagggcaccctggtgaccgtgagcagcggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31201 - RNA, 645 nt, synthetic construct
  misc_feature 1..645: note = derived and/or modified sequence opt4 from Omalizumab_LightChain
  source 1..645: mol_type = other RNA
gacatccagctgacccagagccccagcagcctgagcgccagcgtgggcgacagagtgaccatcacctgcagagccagccagagcgtggactacgacggcgacagctacatgaactggtaccagcagaagcccggcaaggcccccaagctgctgatctacgccgccagctacctggagagcggcgtgcccagcagattcagcggcagcggcagcggcaccgacttcaccctgaccatcagcagcctgcagcccgaggacttcgccacctactactgccagcagagccacgaggacccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 31202 - RNA, 1347 nt, synthetic construct
  misc_feature 1..1347: note = derived and/or modified sequence opt4 from Onartuzumab_HeavyChain1
  source 1..1347: mol_type = other RNA
gaggtgcagctggtggagagcggcggcggcctggtgcagcccggcggcagcctgagactgagctgcgccgccagcggctacaccttcaccagctactggctgcactgggtgagacaggcccccggcaagggcctggagtgggtgggcatgatcgaccccagcaacagcgacaccagattcaaccccaacttcaaggacagattcaccatcagcgccgacaccagcaagaacaccgcctacctgcagatgaacagcctgagagccgaggacaccgccgtgtactactgcgccacctacagaagctacgtgacccccctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgagctgcgccgtgaagggcttctaccccagcgacatcgccgtggagtgggagagcaacggccagcccgagaacaactacaagaccaccccccccgtgctggacagcgacggcagcttcttcctggtgagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31203 - RNA, 681 nt, synthetic construct
  misc_feature 1..681: note = derived and/or modified sequence opt4 from Onartuzumab_HeavyChain2
  source 1..681: mol_type = other RNA
gacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgtggtgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31204 - RNA, 660 nt, synthetic construct
  misc_feature 1..660: note = derived and/or modified sequence opt4 from Onartuzumab_LightChain1
  source 1..660: mol_type = other RNA
gacatccagatgacccagagccccagcagcctgagcgccagcgtgggcgacagagtgaccatcacctgcaagagcagccagagcctgctgtacaccagcagccagaagaactacctggcctggtaccagcagaagcccggcaaggcccccaagctgctgatctactgggccagcaccagagagagcggcgtgcccagcagattcagcggcagcggcagcggcaccgacttcaccctgaccatcagcagcctgcagcccgaggacttcgccacctactactgccagcagtactacgcctacccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31205 - RNA, 1362 nt, synthetic construct
  misc_feature 1..1362: note = derived and/or modified sequence opt4 from Ontuxizumab_HeavyChain1
  source 1..1362: mol_type = other RNA
caggtgcagctgcaggagagcggccccggcctggtgagacccagccagaccctgagcctgacctgcaccgccagcggctacaccttcaccgactacgtgatccactgggtgaagcagccccccggcagaggcctggagtggatcggctacatcaacccctacgacgacgacaccacctacaaccagaagttcaagggcagagtgaccatgctggtggacaccagcagcaacaccgcctacctgagactgagcagcgtgaccgccgaggacaccgccgtgtactactgcgccagaagaggcaacagctacgacggctacttcgactacagcatggactactggggcagcggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcttcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31206 - RNA, 645 nt, synthetic construct
  misc_feature 1..645: note = derived and/or modified sequence opt4 from Ontuxizumab_LightChain1
  source 1..645: mol_type = other RNA
gacatccagatgacccagagccccagcagcctgagcgccagcgtgggcgacagagtgaccatcacctgcagagccagccagaacgtgggcaccgccgtggcctggctgcagcagacccccggcaaggcccccaagctgctgatctacagcgccagcaacagatacaccggcgtgcccagcagattcagcggcagcggcagcggcaccgactacaccttcaccatcagcagcctgcagcccgaggacatcgccacctactactgccagcagtacaccaactaccccatgtacaccttcggccagggcaccaaggtgcagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31207 - RNA, 1341 nt, synthetic construct
  misc_feature 1..1341: note = derived and/or modified sequence opt4 from Opicinumab_HeavyChain1
  source 1..1341: mol_type = other RNA
gaggtgcagctgctggagagcggcggcggcctggtgcagcccggcggcagcctgagactgagctgcgccgccagcggcttcaccttcagcgcctacgagatgaagtgggtgagacaggcccccggcaagggcctggagtgggtgagcgtgatcggccccagcggcggcttcaccttctacgccgacagcgtgaagggcagattcaccatcagcagagacaacagcaagaacaccctgtacctgcagatgaacagcctgagagccgaggacaccgccgtgtactactgcgccaccgagggcgacaacgacgccttcgacatctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcgcctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31208 - RNA, 645 nt, synthetic construct
  misc_feature 1..645: note = derived and/or modified sequence opt4 from Opicinumab_LightChain1
  source 1..645: mol_type = other RNA
gacatccagatgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccatgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31209 - RNA, 1941 nt, synthetic construct
  misc_feature 1..1941: note = derived and/or modified sequence opt4 from Oportuzumab_monatox_HeavyChain1
  source 1..1941: mol_type = other RNA
caccaccaccaccaccacgacatccagatgacccagagccccagcagcctgagcgccagcgtgggcgacagagtgaccatcacctgcagaagcaccaagagcctgctgcacagcaacggcatcacctacctgtactggtaccagcagaagcccggcaaggcccccaagctgctgatctaccagatgagcaacctggccagcggcgtgcccagcagattcagcagcagcggcagcggcaccgacttcaccctgaccatcagcagcctgcagcccgaggacttcgccacctactactgcgcccagaacctggagatccccagaaccttcggccagggcaccaaggtggagctgaagagagccacccccagccacaacagccaccaggtgcccagcgccggcggccccaccgccaacagcggcaccagcggcagcgaggtgcagctggtgcagagcggccccggcctggtgcagcccggcggcagcgtgagaatcagctgcgccgccagcggctacaccttcaccaactacggcatgaactgggtgaagcaggcccccggcaagggcctggagtggatgggctggatcaacacctacaccggcgagagcacctacgccgacagcttcaagggcagattcaccttcagcctggacaccagcgccagcgccgcctacctgcagatcaacagcctgagagccgaggacaccgccgtgtactactgcgccagattcgccatcaagggcgactactggggccagggcaccctgctgaccgtgagcagcgagttcggcggcgcccccgagttccccaagcccagcaccccccccggcagcagcggcctggagggcggcagcctggccgccctgaccgcccaccaggcctgccacctgcccctggagaccttcaccagacacagacagcccagaggctgggagcagctggagcagtgcggctaccccgtgcagagactggtggccctgtacctggccgccagactgagctggaaccaggtggaccaggtgatcagaaacgccctggccagccccggcagcggcggcgacctgggcgaggccatcagagagcagcccgagcaggccagactggccctgaccctggccgccgccgagagcgagagattcgtgagacagggcaccggcaacgacgaggccggcgccgccagcgccgacgtggtgagcctgacctgccccgtggccgccggcgagtgcgccggccccgccgacagcggcgacgccctgctggagagaaactaccccaccggcgccgagttcctgggcgacggcggcgacgtgagcttcagcaccagaggcacccagaactggaccgtggagagactgctgcaggcccacagacagctggaggagagaggctacgtgttcgtgggctaccacggcaccttcctggaggccgcccagagcatcgtgttcggcggcgtgagagccagaagccaggacctggacgccatctggagaggcttctacatcgccggcgaccccgccctggcctacggctacgcccaggaccaggagcccgacgccagaggcagaatcagaaacggcgccctgctgagagtgtacgtgcccagaagcagcctgcccggcttctacagaaccggcctgaccctggccgcccccgaggccgccggcgaggtggagagactgatcggccaccccctgcccctgagactggacgccatcaccggccccgaggaggagggcggcagactggagaccatcctgggctggcccctggccgagagaaccgtggtgatccccagcgccatccccaccgaccccagaaacgtgggcggcgacctggaccccagcagcatccccgacaaggagcaggccatcagcgccctgcccgactacgccagccagcccggcaagcccccccaccaccaccaccaccacaaggacgagctg

SEQ ID NO: 31210 - RNA, 1941 nt, synthetic construct; identical to SEQ ID NO: 31209
  misc_feature 1..1941: note = derived and/or modified sequence opt4 from Oportuzumab_monatox_SingleChain_variable_fragment
  source 1..1941: mol_type = other RNA

SEQ ID NO: 31211 - RNA, 762 nt, synthetic construct
  misc_feature 1..762: note = derived and/or modified sequence opt4 from Oreptacog_alfa_HeavyChain1
  source 1..762: mol_type = other RNA
atcgtgggcggcaaggtgtgccccaagggcgagtgcccctggcaggtgctgctgctggtgaacggcgcccagctgtgcggcggcaccctgatcaacaccatctgggtggtgagcgccgcccactgcttcgacaagatcaagaactggagaaacctgatcgccgtgctgggcgagcacgacctgagcgagcacgacggcgacgagcagagcagaagagtggcccaggtgatcatccccagcacctacgtgcccggcaccaccaaccacgacatcgccctgctgagactgcaccagcccgtgaacctgaccgaccacgtggtgcccctgtgcctgcccgagagaaccttcagcgagagaaccctggccttcgtgagattcagcctggtgagcggctggggccagctgctggacagaggcgccaccgccctggagctgatggtgctgaacgtgcccagactgatgacccaggactgcctgcagcagagcagaaaggtgggcgacagccccaacatcaccgagtacatgttctgcgccggctacagcgacggcagcaaggacagctgcaagggcgacagcggcggcccccacgccacccactacagaggcacctggtacctgaccggcatcgtgagctggggccagggctgcgccaccgtgggccacttcggcgtgtacaccagagtgagccagtacatcgagtggctgcagaagctgatgagaagcgagcccagacccggcgtgctgctgagagcccccttcccc

SEQ ID NO: 31212 - RNA, 456 nt, synthetic construct
  misc_feature 1..456: note = derived and/or modified sequence opt4 from Oreptacog_alfa_LightChain1
  source 1..456: mol_type = other RNA
gccaacgccttcctggaggagctgagacagggcagcctggagagagagtgcaaggaggagcagtgcagcttcgaggaggccagagagatcttcgaggacgaggaggagaccaagctgttctggatcagctacagcgacggcgaccagtgcgccagcagcccctgccagaacggcggcagctgcaaggaccagctgcagagctacatctgcttctgcctgcccgccttcgagggcagaaactgcgagacccacaaggacgaccagctgatctgcgtgaacgagaacggcggctgcgagcagtactgcagcgaccacaacggcaccaagagaagctgcagatgccacgagggctacagcctgctggccgacggcgtgagctgcacccccaccgtggagtacccctgcggcaagatccccatcctggagaagagaaacgccagcaagccccagggcaga

SEQ ID NO: 31213 - RNA, 1353 nt, synthetic construct
  misc_feature 1..1353: note = derived and/or modified sequence opt4 from Orticumab_HeavyChain1
  source 1..1353: mol_type = other RNA
gaggtgcagctgctggagagcggcggcggcctggtgcagcccggcggcagcctgagactgagctgcgccgccagcggcttcaccttcagcaacgcctggatgagctgggtgagacaggcccccggcaagggcctggagtgggtgagcagcatcagcgtgggcggccacagaacctactacgccgacagcgtgaagggcagaagcaccatcagcagagacaacagcaagaacaccctgtacctgcagatgaacagcctgagagccgaggacaccgccgtgtactactgcgccagaatcagagtgggccccagcggcggcgccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31214 - RNA, 648 nt, synthetic construct
  misc_feature 1..648: note = derived and/or modified sequence opt4 from Orticumab_LightChain1
  source 1..648: mol_type = other RNA
cagagcgtgctgacccagccccccagcgccagcggcacccccggccagagagtgaccatcagctgcagcggcagcaacaccaacatcggcaagaactacgtgagctggtaccagcagctgcccggcaccgcccccaagctgctgatctacgccaacagcaacagacccagcggcgtgcccgacagattcagcggcagcaagagcggcaccagcgccagcctggccatcagcggcctgagaagcgaggacgaggccgactactactgcgccagctgggacgccagcctgaacggctgggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31215 - RNA, 1347 nt, synthetic construct
  misc_feature 1..1347: note = derived and/or modified sequence opt4 from Otelixizumab_HeavyChain1
  source 1..1347: mol_type = other RNA
gaggtgcagctgctggagagcggcggcggcctggtgcagcccggcggcagcctgagactgagctgcgccgccagcggcttcaccttcagcagcttccccatggcctgggtgagacaggcccccggcaagggcctggagtgggtgagcaccatcagcaccagcggcggcagaacctactacagagacagcgtgaagggcagattcaccatcagcagagacaacagcaagaacaccctgtacctgcagatgaacagcctgagagccgaggacaccgccgtgtactactgcgccaagttcagacagtacagcggcggcttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31216 - RNA, 648 nt, synthetic construct
  misc_feature 1..648: note = derived and/or modified sequence opt4 from Otelixizumab_LightChain1
  source 1..648: mol_type = other RNA
gacatccagctgacccagcccaacagcgtgagcaccagcctgggcagcaccgtgaagctgagctgcaccctgagcagcggcaacatcgagaacaactacgtgcactggtaccagctgtacgagggcagaagccccaccaccatgatctacgacgacgacaagagacccgacggcgtgcccgacagattcagcggcagcatcgacagaagcagcaacagcgccttcctgaccatccacaacgtggccatcgaggacgaggccatctacttctgccacagctacgtgagcagcttcaacgtgttcggcggcggcaccaagctgaccgtgctgagacagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31217 - RNA, 1449 nt, synthetic construct
  misc_feature 1..1449: note = derived and/or modified sequence opt4 from Otlertuzumab_HeavyChain1
  source 1..1449: mol_type = other RNA
gaggtgcagctggtgcagagcggcgccgaggtgaagaagcccggcgagagcctgaagatcagctgcaagggcagcggctacagcttcaccggctacaacatgaactgggtgagacagatgcccggcaagggcctggagtggatgggcaacatcgacccctactacggcggcaccacctacaacagaaagttcaagggccaggtgaccatcagcgccgacaagagcatcagcaccgcctacctgcagtggagcagcctgaaggccagcgacaccgccatgtactactgcgccagaagcgtgggccccttcgacagctggggccagggcaccctggtgaccgtgagcagcggcggcggcggcagcggcggcggcggcagcggcggcggcggcagcggcggcggcggcagcggcggcggcggcagcgagatcgtgctgacccagagccccgccaccctgagcctgagccccggcgagagagccaccctgagctgcagagccagcgagaacgtgtacagctacctggcctggtaccagcagaagcccggccaggcccccagactgctgatctacttcgccaagaccctggccgagggcatccccgccagattcagcggcagcggcagcggcaccgacttcaccctgaccatcagcagcctggagcccgaggacttcgccgtgtactactgccagcaccacagcgacaacccctggaccttcggccagggcaccaaggtggagatcaagggcgaccaggagcccaagagcagcgacaagacccacaccagccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31218 - RNA, 1347 nt, synthetic construct
  misc_feature 1..1347: note = derived and/or modified sequence opt4 from Oxelumab_HeavyChain1
  source 1..1347: mol_type = other RNA
gaggtgcagctgctggagagcggcggcggcctggtgcagcccggcggcagcctgagactgagctgcgccgccagcggcttcaccttcaacagctacgccatgagctgggtgagacaggcccccggcaagggcctggagtgggtgagcatcatcagcggcagcggcggcttcacctactacgccgacagcgtgaagggcagattcaccatcagcagagacaacagcagaaccaccctgtacctgcagatgaacagcctgagagccgaggacaccgccgtgtactactgcgccaaggacagactggtggcccccggcaccttcgactactggggccagggcgccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31219 - RNA, 642 nt, synthetic construct
  misc_feature 1..642: note = derived and/or modified sequence opt4 from Oxelumab_LightChain1
  source 1..642: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31220 - RNA, 1329 nt, synthetic construct
  misc_feature 1..1329: note = derived and/or modified sequence opt4 from Ozanezumab_HeavyChain1
  source 1..1329: mol_type = other RNA
caggtgcagctggtgcagagcggcgccgaggtgaagaagcccggcgccagcgtgaaggtgagctgcaaggccagcggctacaccttcaccagctactggatgcactgggtgagacaggcccccggccagggcctggagtggatcggcaacatcaaccccagcaacggcggcaccaactacaacgagaagttcaagagcaaggccaccatgaccagagacaccagcaccagcaccgcctacatggagctgagcagcctgagaagcgaggacaccgccgtgtactactgcgagctgatgcagggctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31221 - RNA, 657 nt, synthetic construct
  misc_feature 1..657: note = derived and/or modified sequence opt4 from Ozanezumab_LightChain1
  source 1..657: mol_type = other RNA
gacatcgtgatgacccagagccccctgagcaaccccgtgaccctgggccagcccgtgagcatcagctgcagaagcagcaagagcctgctgtacaaggacggcaagacctacctgaactggttcctgcagagacccggccagagcccccagctgctgatctacctgatgagcaccagagccagcggcgtgcccgacagattcagcggcggcggcagcggcaccgacttcaccctgaagatcagcagagtggaggccgaggacgtgggcgtgtactactgccagcagctggtggagtaccccctgaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31222 - RNA, 1089 nt, synthetic construct
  misc_feature 1..1089: note = derived and/or modified sequence opt4 from Ozoralizumab_HeavyChain1
  source 1..1089: mol_type = other RNA
gaggtgcagctggtggagagcggcggcggcctggtgcagcccggcggcagcctgagactgagctgcgccgccagcggcttcaccttcagcgactactggatgtactgggtgagacaggcccccggcaagggcctggagtgggtgagcgagatcaacaccaacggcctgatcaccaagtaccccgacagcgtgaagggcagattcaccatcagcagagacaacgccaagaacaccctgtacctgcagatgaacagcctgagacccgaggacaccgccgtgtactactgcgccagaagccccagcggcttcaacagaggccagggcaccctggtgaccgtgagcagcggcggcggcggcagcggcggcggcagcgaggtgcagctggtggagagcggcggcggcctggtgcagcccggcaacagcctgagactgagctgcgccgccagcggcttcaccttcagcagcttcggcatgagctgggtgagacaggcccccggcaagggcctggagtgggtgagcagcatcagcggcagcggcagcgacaccctgtacgccgacagcgtgaagggcagattcaccatcagcagagacaacgccaagaccaccctgtacctgcagatgaacagcctgagacccgaggacaccgccgtgtactactgcaccatcggcggcagcctgagcagaagcagccagggcaccctggtgaccgtgagcagcggcggcggcggcagcggcggcggcagcgaggtgcagctggtggagagcggcggcggcctggtgcagcccggcggcagcctgagactgagctgcgccgccagcggcttcaccttcagcgactactggatgtactgggtgagacaggcccccggcaagggcctggagtgggtgagcgagatcaacaccaacggcctgatcaccaagtaccccgacagcgtgaagggcagattcaccatcagcagagacaacgccaagaacaccctgtacctgcagatgaacagcctgagacccgaggacaccgccgtgtactactgcgccagaagccccagcggcttcaacagaggccagggcaccctggtgaccgtgagcagc

SEQ ID NO: 31223 - RNA, 1350 nt, synthetic construct
  misc_feature 1..1350: note = derived and/or modified sequence opt4 from Palivizumab_HeavyChain
  source 1..1350: mol_type = other RNA
caggtgaccctgagagagagcggccccgccctggtgaagcccacccagaccctgaccctgacctgcaccttcagcggcttcagcctgagcaccagcggcatgagcgtgggctggatcagacagccccccggcaaggccctggagtggctggccgacatctggtgggacgacaagaaggactacaaccccagcctgaagagcagactgaccatcagcaaggacaccagcaagaaccaggtggtgctgaaggtgaccaacatggaccccgccgacaccgccacctactactgcgccagaagcatgatcaccaactggtacttcgacgtgtggggcgccggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31224 - RNA, 639 nt, synthetic construct
  misc_feature 1..639: note = derived and/or modified sequence opt4 from Palivizumab_LightChain
  source 1..639: mol_type = other RNA
gacatccagatgacccagagccccagcaccctgagcgccagcgtgggcgacagagtgaccatcacctgcaagtgccagctgagcgtgggctacatgcactggtaccagcagaagcccggcaaggcccccaagctgctgatctacgacaccagcaagctggccagcggcgtgcccagcagattcagcggcagcggcagcggcaccgagttcaccctgaccatcagcagcctgcagcccgacgacttcgccacctactactgcttccagggcagcggctaccccttcaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31225 - RNA, 360 nt, synthetic construct
  misc_feature 1..360: note = derived and/or modified sequence opt4 from Palivizumab_VH-Region
  source 1..360: mol_type = other RNA
caggtgaccctgagagagagcggccccgccctggtgaagcccacccagaccctgaccctgacctgcaccttcagcggcttcagcctgagcaccagcggcatgagcgtgggctggatcagacagccccccggcaaggccctggagtggctggccgacatctggtgggacgacaagaaggactacaaccccagcctgaagagcagactgaccatcagcaaggacaccagcaagaaccaggtggtgctgaaggtgaccaacatggaccccgccgacaccgccacctactactgcgccagaagcatgatcaccaactggtacttcgacgtgtggggcgccggcaccaccgtgaccgtgagcagc

SEQ ID NO: 31226 - RNA, 1347 nt, synthetic construct; identical to SEQ ID NO: 30862
  misc_feature 1..1347: note = derived and/or modified sequence opt4 from Pamrevlumab_HeavyChain1
  source 1..1347: mol_type = other RNA

SEQ ID NO: 31227 - RNA, 642 nt, synthetic construct; identical to SEQ ID NO: 30863
  misc_feature 1..642: note = derived and/or modified sequence opt4 from Pamrevlumab_LightChain1
  source 1..642: mol_type = other RNA

SEQ ID NO: 31228 - RNA, 1305 nt, synthetic construct
  misc_feature 1..1305: note = derived and/or modified sequence opt4 from Panitumumab_HeavyChain1
  source 1..1305: mol_type = other RNA
caggtgcagctgcaggagagcggccccggcctggtgaagcccagcgagaccctgagcctgacctgcaccgtgagcggcggcagcgtgagcagcggcgactactactggacctggatcagacagagccccggcaagggcctggagtggatcggccacatctactacagcggcaacaccaactacaaccccagcctgaagagcagactgaccatcagcatcgacaccagcaagacccagttcagcctgaagctgagcagcgtgaccgccgccgacaccgccatctactactgcgtgagagacagagtgaccggcgccttcgacatctggggccagggcaccatggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacgagagaaagtgctgcgtggagtgccccgccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31229 - RNA, 642 nt, synthetic construct
  misc_feature 1..642: note = derived and/or modified sequence opt4 from Panitumumab_LightChain1
  source 1..642: mol_type = other RNA
gacatccagatgacccagagccccagcagcctgagcgccagcgtgggcgacagagtgaccatcacctgccaggccagccaggacatcagcaactacctgaactggtaccagcagaagcccggcaaggcccccaagctgctgatctacgacgccagcaacctggagaccggcgtgcccagcagattcagcggcagcggcagcggcaccgacttcaccttcaccatcagcagcctgcagcccgaggacatcgccacctacttctgccagcacttcgaccacctgcccctggccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31230 - RNA, 1326 nt, synthetic construct
  misc_feature 1..1326: note = derived and/or modified sequence opt4 from Pankoab_HeavyChain1
  source 1..1326: mol_type = other RNA
gaggtgcagctggtggagagcggcggcggcctggtgcagcccggcggcagcagactgagctgcgtggccagcggcttccccttcagcaactactggaactgggtgagacaggcccccggcaagggcctggagtgggtgggcgagatcagactgaagagcaacaactacaccacccactacgccgagagcgtgaagggcagattcaccatcagcagagacgacagcaagaacagcctgtacctgcagaacagcctgaagaccgaggacaccgccgtgtactactgcaccagacactactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgagggcctgcacaaccactacacccagaagagcctgagcctgagccccggcaag

SEQ ID NO: 31231 - RNA, 651 nt, synthetic construct
  misc_feature 1..651: note = derived and/or modified sequence opt4 from Pankoab_LightChain1
  source 1..651: mol_type = other RNA
gacatcgtgacccagagccccctgagcaaccccgtgacccccggcgagcccgccagcatcagctgcagaagcagcaagagcctgctgcacagcaacggcatcacctacttcttctggtacctgcagaagcccggccagagcccccagctgctgatctaccagagcaacctggccagcggcgtgcccgacagattcagcggcagcggcagcggcaccgacttcaccctgagaatcagcagagtggaggccgaggacgtgggcgtgtactactgcgcccagaacctggagctgccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31232 - RNA, 651 nt, synthetic construct
  misc_feature 1..651: note = derived and/or modified sequence opt4 from Pankoab_LightChain2
  source 1..651: mol_type = other RNA
gacatcgtgacccagagccccctgagcaaccccgtgacccccggcgagcccgccagcatcagctgcagaagcagcaagagcctgctgcacagcaacggcatcacctacttcttctggtacctgcagaagcccggccagagcccccagctgctgatctaccagagcaacctggccagcggcgtgcccgacagattcagcggcagcggcagcggcaccgacttcaccctgagaatcagcagagtggaggccgaggacgtgggcgtgtactactgcgccggcaacctggagctgccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31233 - RNA, 351 nt, synthetic construct
  misc_feature 1..351: note = derived and/or modified sequence opt4 from PankoMab_HeavyChain_VDJ-Region
  source 1..351: mol_type = other RNA
gaggtgaagctggtggagagcggcggcggcctggtgcagcccggcggcagcatgaagctgagctgcgtggccagcggcttcaccttcagcaactactggatgaactgggtgagacagagccccgagaagggcctggagtgggtggccgagatcagactgaagagcaacaactacaccacccactacgccgagagcgtgaagggcagattcaccatcagcagagacgacagcaagagcagcgtgagcctgcagatgaacaacctgagagtggaggacaccggcatctactactgcaccagacactactacttcgactactggggccagggcaccaccctgaccgtgagcagc

SEQ ID NO: 31234 - RNA, 339 nt, synthetic construct
  misc_feature 1..339: note = derived and/or modified sequence opt4 from PankoMab_LightChain_VJ-Region
  source 1..339: mol_type = other RNA
gacatcgtgatgacccaggccgccttcagcaaccccgtgaccctgggcaccagcgccagcatcagctgcagaagcagcaagagcctgctgcacagcaacggcatcacctacttcttctggtacctgcagaagcccggcctgagcccccagctgctgatctaccagatgagcaacctggccagcggcgtgcccgacagattcagcagcagcggcagcggcaccgacttcaccctgagaatcagcagagtggaggccgaggacgtgggcgtgtactactgcgcccagaacctggagctgccccccaccttcggcggcggcaccaagctggagatcaagaga

SEQ ID NO: 31235 - RNA, 1707 nt, synthetic construct
  misc_feature 1..1707: note = derived and/or modified sequence opt4 from Panobacumab_HeavyChain1
  source 1..1707: mol_type = other RNA
gaggagcaggtggtggagagcggcggcggcttcgtgcagcccggcggcagcctgagactgagctgcgccgccagcggcttcaccttcagcccctactggatgcactgggtgagacaggcccccggcaagggcctggtgtgggtgagcagaatcaacagcgacggcagcacctactacgccgacagcgtgaagggcagattcaccatcagcagagacaacgccagaaacaccctgtacctgcagatgaacagcctgagagccgaggacaccgccgtgtactactgcgccagagacagatactacggccccgagatgtggggccagggcaccatggtgaccgtgagcagcggcagcgccagcgcccccaccctgttccccctggtgagctgcgagaacagccccagcgacaccagcagcgtggccgtgggctgcctggcccaggacttcctgcccgacagcatcaccttcagctggaagtacaagaacaacagcgacatcagcagcaccagaggcttccccagcgtgctgagaggcggcaagtacgccgccaccagccaggtgctgctgcccagcaaggacgtgatgcagggcaccgacgagcacgtggtgtgcaaggtgcagcaccccaacggcaacaaggagaagaacgtgcccctgcccgtgatcgccgagctgccccccaaggtgagcgtgttcgtgccccccagagacggcttcttcggcaaccccagaaagagcaagctgatctgccaggccaccggcttcagccccagacagatccaggtgagctggctgagagagggcaagcaggtgggcagcggcgtgaccaccgaccaggtgcaggccgaggccaaggagagcggccccaccacctacaaggtgaccagcaccctgaccatcaaggagagcgactggctgagccagagcatgttcacctgcagagtggaccacagaggcctgaccttccagcagaacgccagcagcatgtgcgtgcccgaccaggacaccgccatcagagtgttcgccatcccccccagcttcgccagcatcttcctgaccaagagcaccaagctgacctgcctggtgaccgacctgaccacctacgacagcgtgaccatcagctggaccagacagaacggcgaggccgtgaagacccacaccaacatcagcgagagccaccccaacgccaccttcagcgccgtgggcgaggccagcatctgcgaggacgactggaacagcggcgagagattcacctgcaccgtgacccacaccgacctgcccagccccctgaagcagaccatcagcagacccaagggcgtggccctgcacagacccgacgtgtacctgctgccccccgccagagagcagctgaacctgagagagagcgccaccatcacctgcctggtgaccggcttcagccccgccgacgtgttcgtgcagtggatgcagagaggccagcccctgagccccgagaagtacgtgaccagcgcccccatgcccgagccccaggcccccggcagatacttcgcccacagcatcctgaccgtgagcgaggaggagtggaacaccggcgagacctacacctgcgtggtggcccacgaggccctgcccaacagagtgaccgagagaaccgtggacaagagcaccggcaagcccaccctgtacaacgtgagcctggtgatgagcgacaccgccggcacctgctac

SEQ ID NO: 31236 - RNA, 657 nt, synthetic construct
  misc_feature 1..657: note = derived and/or modified sequence opt4 from Panobacumab_LightChain1
  source 1..657: mol_type = other RNA
gacgtggtgatgacccagagccccctgagcctgcccgtgaccctgggccagcccgccagcatcagctgcagaagcagccagagcctggtgtacagcgacggcaacacctacctgaactggttccagcagagacccggccagagccccagaagactgatctacaaggtgagcaacagagacagcggcgtgcccgacagattcagcggcagcggcagcggcaccgacttcaccctgaagatcagcagagtggaggccgaggacgtgggcgtgtactactgcatgcagggcacccactggcccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31237 - RNA, 414 nt, synthetic construct
  misc_feature 1..414: note = derived and/or modified sequence opt4 from Panobacumab_LightChain2
  source 1..414: mol_type = other RNA
ggcgacgacgaggccaccatcctggccgacaacaagtgcatgtgcaccagagtgaccagcagaatcatccccagcaccgaggaccccaacgaggacatcgtggagagaaacatcagaatcgtggtgcccctgaacaacagagagaacatcagcgaccccaccagccccctgagaagaaacttcgtgtaccacctgagcgacgtgtgcaagaagtgcgaccccgtggaggtggagctggaggaccaggtggtgaccgccacccagagcaacatctgcaacgaggacgacggcgtgcccgagacctgctacatgtacgacagaaacaagtgctacaccaccatggtgcccctgagataccacggcgagaccaagatggtgcaggccgccctgacccccgacagctgctaccccgac

SEQ ID NO: 31238 - RNA, 1359 nt, synthetic construct
  misc_feature 1..1359: note = derived and/or modified sequence opt4 from Parsatuzumab_HeavyChain1
  source 1..1359: mol_type = other RNA
gaggtgcagctggtggagagcggcggcggcctggtgcagcccggcggcagcctgagactgagctgcgccgccagcggctacaccttcatcgactactacatgaactgggtgagacaggcccccggcaagggcctggagtgggtgggcgacatcaacctggacaacagcggcacccactacaaccagaagttcaagggcagattcaccatcagcagagacaagagcaagaacaccgcctacctgcagatgaacagcctgagagccgaggacaccgccgtgtactactgcgccagagagggcgtgtaccacgactacgacgactacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31239 - RNA, 657 nt, synthetic construct
  misc_feature 1..657: note = derived and/or modified sequence opt4 from Parsatuzumab_LightChain1
  source 1..657: mol_type = other RNA
gacatccagatgacccagagccccagcagcctgagcgccagcgtgggcgacagagtgaccatcacctgcagaaccagccagagcctggtgcacatcaacgccatcacctacctgcactggtaccagcagaagcccggcaaggcccccaagctgctgatctacagagtgagcaacagattcagcggcgtgcccagcagattcagcggcagcggcagcggcaccgacttcaccctgaccatcagcagcctgcagcccgaggacttcgccacctactactgcggccagagcacccacgtgcccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31240 - RNA, 1353 nt, synthetic construct
  misc_feature 1..1353: note = derived and/or modified sequence opt4 from Pascolizumab_HeavyChain1
  source 1..1353: mol_type = other RNA
caggtgaccctgagagagagcggccccgccctggtgaagcccacccagaccctgaccctgacctgcaccttcagcggcttcagcctgagcaccagcggcatgggcgtgagctggatcagacagccccccggcaagggcctggagtggctggcccacatctactgggacgacgacaagagatacaaccccagcctgaagagcagactgaccatcagcaaggacaccagcagaaaccaggtggtgctgaccatgaccaacatggaccccgtggacaccgccacctactactgcgccagaagagagaccgtgttctactggtacttcgacgtgtggggcagaggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31241 - RNA, 654 nt, synthetic construct
  misc_feature 1..654: note = derived and/or modified sequence opt4 from Pascolizumab_LightChain1
  source 1..654: mol_type = other RNA
gacatcgtgctgacccagagccccagcagcctgagcgccagcgtgggcgacagagtgaccatcacctgcaaggccagccagagcgtggactacgacggcgacagctacatgaactggtaccagcagaagcccggcaaggcccccaagctgctgatctacgccgccagcaacctggagagcggcatccccagcagattcagcggcagcggcagcggcaccgacttcaccttcaccatcagcagcctgcagcccgaggacatcgccacctactactgccagcagagcaacgaggacccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31242 - RNA, 1512 nt, synthetic construct
  misc_feature 1..1512: note = derived and/or modified sequence opt4 from Pasotuxizumab_HeavyChain1
  source 1..1512: mol_type = other RNA
caggtgcagctggtggagagcggcggcggcctggtgaagcccggcgagagcctgagactgagctgcgccgccagcggcttcaccttcagcgactactacatgtactgggtgagacaggcccccggcaagggcctggagtgggtggccatcatcagcgacggcggctactacacctactacagcgacatcatcaagggcagattcaccatcagcagagacaacgccaagaacagcctgtacctgcagatgaacagcctgaaggccgaggacaccgccgtgtactactgcgccagaggcttccccctgctgagacacggcgccatggactactggggccagggcaccctggtgaccgtgagcagcggcggcggcggcagcggcggcggcggcagcggcggcggcggcagcgacatccagatgacccagagccccagcagcctgagcgccagcgtgggcgacagagtgaccatcacctgcaaggccagccagaacgtggacaccaacgtggcctggtaccagcagaagcccggccaggcccccaagagcctgatctacagcgccagctacagatacagcgacgtgcccagcagattcagcggcagcgccagcggcaccgacttcaccctgaccatcagcagcgtgcagagcgaggacttcgccacctactactgccagcagtacgacagctacccctacaccttcggcggcggcaccaagctggagatcaagagcggcggcggcggcagcgaggtgcagctggtggagagcggcggcggcctggtgcagcccggcggcagcctgaagctgagctgcgccgccagcggcttcaccttcaacaagtacgccatgaactgggtgagacaggcccccggcaagggcctggagtgggtggccagaatcagaagcaagtacaacaactacgccacctactacgccgacagcgtgaaggacagattcaccatcagcagagacgacagcaagaacaccgcctacctgcagatgaacaacctgaagaccgaggacaccgccgtgtactactgcgtgagacacggcaacttcggcaacagctacatcagctactgggcctactggggccagggcaccctggtgaccgtgagcagcggcggcggcggcagcggcggcggcggcagcggcggcggcggcagccagaccgtggtgacccaggagcccagcctgaccgtgagccccggcggcaccgtgaccctgacctgcggcagcagcaccggcgccgtgaccagcggcaactaccccaactgggtgcagcagaagcccggccaggcccccagaggcctgatcggcggcaccaagttcctggcccccggcacccccgccagattcagcggcagcctgctgggcggcaaggccgccctgaccctgagcggcgtgcagcccgaggacgaggccgagtactactgcgtgctgtggtacagcaacagatgggtgttcggcggcggcaccaagctgaccgtgctgcaccaccaccaccaccac

SEQ ID NO: 31243 - RNA, 1512 nt, synthetic construct
  misc_feature 1..1512: note = derived and/or modified sequence opt4 from Pasotuxizumab_SingleChain
  source 1..1512: mol_type = other RNA
caggtgcagctggtgcagagcggcggcggcctggtgaagcccggcgagagcctgagactgagctgcgccgccagcggcttcaccttcagcgactactacatgtactgggtgagacaggcccccggcaagggcctggagtgggtggccatcatcagcgacggcggctactacacctactacagcgacatcatcaagggcagattcaccatcagcagagacaacgccaagaacagcctgtacctgcagatgaacagcctgaaggccgaggacaccgccgtgtactactgcgccagaggcttccccctgctgagacacggcgccatggactactggggccagggcaccctggtgaccgtgagcagcggcggcggcggcagcggcggcggcggcagcggcggcggcggcagcgacatccagatgacccagagccccagcagcctgagcgccagcgtgggcgacagagtgaccatcacctgcaaggccagccagaacgtggacaccaacgtggcctggtaccagcagaagcccggccaggcccccaagagcctgatctacagcgccagctacagatacagcgacgtgcccagcagattcagcggcagcgccagcggcaccgacttcaccctgaccatcagcagcgtgcagagcgaggacttcgccacctactactgccagcagtacgacagctacccctacaccttcggcggcggcaccaagctggagatcaagagcggcggcggcggcagcgaggtgcagctggtggagagcggcggcggcctggtgcagcccggcggcagcctgaagctgagctgcgccgccagcggcttcaccttcaacaagtacgccatgaactgggtgagacaggcccccggcaagggcctggagtgggtggccagaatcagaagcaagtacaacaactacgccacctactacgccgacagcgtgaaggacagattcaccatcagcagagacgacagcaagaacaccgcctacctgcagatgaacaacctgaagaccgaggacaccgccgtgtactactgcgtgagacacggcaacttcggcaacagctacatcagctactgggcctactggggccagggcaccctggtgaccgtgagcagcggcggcggcggcagcggcggcggcggcagcggcggcggcggcagccagaccgtggtgacccaggagcccagcctgaccgtgagccccggcggcaccgtgaccctgacctgcggcagcagcaccggcgccgtgaccagcggcaactaccccaactgggtgcagcagaagcccggccaggcccccagaggcctgatcggcggcaccaagttcctggcccccggcacccccgccagattcagcggcagcctgctgggcggcaaggccgccctgaccctgagcggcgtgcagcccgaggacgaggccgagtactactgcgtgctgtggtacagcaacagatgggtgttcggcggcggcaccaagctgaccgtgctgcaccaccaccaccaccac

SEQ ID NO: 31244 - RNA, 1341 nt, synthetic construct
  misc_feature 1..1341: note = derived and/or modified sequence opt4 from Pateclizumab_HeavyChain1
  source 1..1341: mol_type = other RNA
gaggtgcagctggtggagagcggcggcggcctggtgcagcccggcggcagcctgagactgagctgcgccgccagcggctacaccttcaccagctacgtgatccactgggtgagacaggcccccggcaagggcctggagtgggtgggctacaacaacccctacaacgccggcaccaactacaacgagaagttcaagggcagattcaccatcagcagcgacaagagcaagaacaccgcctacctgcagatgaacagcctgagagccgaggacaccgccgtgtactactgcagcagacccaccatgctgccctggttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31245 - RNA, 642 nt, synthetic construct
  misc_feature 1..642: note = derived and/or modified sequence opt4 from Pateclizumab_LightChain1
  source 1..642: mol_type = other RNA
gacatccagatgacccagagccccagcagcctgagcgccagcgtgggcgacagagtgaccatcacctgcagagccagccaggccgtgagcagcgccgtggcctggtaccagcagaagcccggcaaggcccccaagctgctgatctacagcgccagccacagatacaccggcgtgcccagcagattcagcggcagcggcagcggcaccgacttcaccctgaccatcagcagcctgcagcccgaggacttcgccacctactactgccaggagagctacagcaccccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31246 - RNA, 1341 nt, synthetic construct
  misc_feature 1..1341: note = derived and/or modified sequence opt4 from Patritumab_HeavyChain1
  source 1..1341: mol_type = other RNA
caggtgcagctgcagcagtggggcgccggcctgctgaagcccagcgagaccctgagcctgacctgcgccgtgtacggcggcagcttcagcggctactactggagctggatcagacagccccccggcaagggcctggagtggatcggcgagatcaaccacagcggcagcaccaactacaaccccagcctgaagagcagagtgaccatcagcgtggagaccagcaagaaccagttcagcctgaagctgagcagcgtgaccgccgccgacaccgccgtgtactactgcgccagagacaagtggacctggtacttcgacctgtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31247 - RNA, 681 nt, synthetic construct; identical to SEQ ID NO: 31203
  misc_feature 1..681: note = derived and/or modified sequence opt4 from Patritumab_hinge-CH2-CH3
  source 1..681: mol_type = other RNA

SEQ ID NO: 31248 - RNA, 660 nt, synthetic construct
  misc_feature 1..660: note = derived and/or modified sequence opt4 from Patritumab_LightChain1
  source 1..660: mol_type = other RNA
gacatcgagatgacccagagccccgacagcctggccgtgagcctgggcgagagagccaccatcaactgcagaagcagccagagcgtgctgtacagcagcagcaacagaaactacctggcctggtaccagcagaaccccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcacccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31249 - RNA, 1341 nt, synthetic construct; identical to SEQ ID NO: 31064
  misc_feature 1..1341: note = derived and/or modified sequence opt4 from Pembrolizumab_HeavyChain1
  source 1..1341: mol_type = other RNA

SEQ ID NO: 31250 - RNA, 654 nt, synthetic construct; identical to SEQ ID NO: 31065
  misc_feature 1..654: note = derived and/or modified sequence opt4 from Pembrolizumab_LightChain1
  source 1..654: mol_type = other RNA

SEQ ID NO: 31251 - RNA, 1356 nt, synthetic construct
  misc_feature 1..1356: note = derived and/or modified sequence opt4 from Perakizumab_HeavyChain1
  source 1..1356: mol_type = other RNA
gaggtgcagctggtggagagcggcggcggcctggtgcagcccggcggcagcctgagactgagctgcgccgccagcggcttcaccttcagcgactacaccatgctgtgggtgagacaggcccccggcaagggcctggagtgggtggccatcatcaagagcggcggcagctacagctactaccccgacagcgtgaagggcagattcaccatcagcagagacaacgccaagaacagcctgtacctgcagatgaacagcctgagagccgaggacaccgccgtgtactactgcgccagagacggcgactacggcagcagctacggcgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31252 - RNA, 645 nt, synthetic construct
  misc_feature 1..645: note = derived and/or modified sequence opt4 from Perakizumab_LightChain1
  source 1..645: mol_type = other RNA
gacatccagatgacccagagccccagcagcctgagcgccagcgtgggcgacagagtgaccatcacctgcagagccagccaggacatcaacagctacctgagctggttccagcagaagcccggcaaggcccccaagagcctgatcgtgagagccaacagactggtggacggcgtgcccagcagattcagcggcagcggcagcggccaggactacagcctgaccatcagcagcctgcagcccgaggacttcgccacctactactgcctgcagtacgacgccttccccccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31253 - RNA, 1332 nt, synthetic construct
  misc_feature 1..1332: note = derived and/or modified sequence opt4 from Pertuzuab_HeavyChain1
  source 1..1332: mol_type = other RNA
gaggtgcagctggtggagagcggcggcggcctggtgcagcccggcggcagcctgagactgagctgcgccgccagcggcttcaccttcaccgactacaccgactgggtgagacaggcccccggcaagggcctggagtgggtggccgacgtgaaccccaacagcggcggcagcatctacaaccagagattcaagggcagattcaccctgagcgtggacagaagcaagaacaccctgtacctgcagaacagcctgagagccgaggacaccgccgtgtactactgcgccagaaacctgggccccagcttctacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 31254 - RNA, 639 nt, synthetic construct
  misc_feature 1..639: note = derived and/or modified sequence opt4 from Pertuzuab_LightChain1
  source 1..639: mol_type = other RNA
gacatccagacccagagccccagcagcctgagcgccagcgtgggcgacagagtgaccatcacctgcaaggccagccaggacgtgagcatcggcgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagtactacatctacccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31255 - RNA, 642 nt, synthetic construct
  misc_feature 1..642: note = derived and/or modified sequence opt4 from Pertuzumab_HeavyChain
  source 1..642: mol_type = other RNA
gacatccagatgacccagagccccagcagcctgagcgccagcgtgggcgacagagtgaccatcacctgcaaggccagccaggacgtgagcatcggcgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagtactacatctacccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31256 - RNA, 1344 nt, synthetic construct
  misc_feature 1..1344: note = derived and/or modified sequence opt4 from Pertuzumab_LightChain
  source 1..1344: mol_type = other RNA
gaggtgcagctggtggagagcggcggcggcctggtgcagcccggcggcagcctgagactgagctgcgccgccagcggcttcaccttcaccgactacaccatggactgggtgagacaggcccccggcaagggcctggagtgggtggccgacgtgaaccccaacagcggcggcagcatctacaaccagagattcaagggcagattcaccctgagcgtggacagaagcaagaacaccctgtacctgcagatgaacagcctgagagccgaggacaccgccgtgtactactgcgccagaaacctgggccccagcttctacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31257 - RNA, 750 nt, synthetic construct
  misc_feature 1..750: note = derived and/or modified sequence opt4 from Pexelizumab_h5g1.1-scFv
  source 1..750: mol_type = other RNA
atggccgacatccagatgacccagagccccagcagcctgagcgccagcgtgggcgacagagtgaccatcacctgcggcgccagcgagaacatctacggcgccctgaactggtaccagagaaagcccggcaaggcccccaagctgctgatctacggcgccaccaacctggccgacggcgtgcccagcagattcagcggcagcggcagcggcaccgactacaccctgaccatcagcagcctgcagcccgaggacttcgccacctactactgccagaacgtgctgaacacccccctgaccttcggccagggcaccaaggtggagatcaagagaaccggcggcggcggcagcggcggcggcggcagcggcggcggcggcagccaggtgcagctggtgcagagcggcgccgaggtggagaagcccggcgccagcgtgaagaaggtgagctgcaaggccagcggctacatcttcagcaactactggatccagtgggtgagacaggcccccggccagggcctggagtggatgggcgagatcctgcccggcagcggcagcaccgagtacgcccagaagttccagggcagagtgaccatgaccgccgacaccagcaccagcaccgcctacatggagctgagcagcctgagaagcgaggacaccgccgtgtactactgcgccagatacttcttcggcagcagccccaactactggtacttcgacgtgtggggccagggcaccctggtgaccgtgagcagc

SEQ ID NO: 31258 - RNA, 345 nt, synthetic construct
  misc_feature 1..345: note = derived and/or modified sequence opt4 from Pexelizumab_h5g1.1VHC_+_F_Heavy_Chain_V-Region
  source 1..345: mol_type = other RNA
caggtgcagctggtgcagagcggcgccgaggtgaagaagcccggcgccagcgtgaaggtgagctgcaaggccagcggctacatcttcagcaactactggatccagtgggtgagacaggcccccggccagggcctggagtggatgggcgagatcctgcccggcagcggcagcaccgagtacgcccagaagttccagggcagagtgaccatgaccgccgacaccagcaccagcaccgcctacatggagctgagcagcctgagaagcgaggacaccgccgtgtactactgcgccagatacttcttcggcagcagccccaactggtacttcgtgtggggccagggcacc

SEQ ID NO: 31259 - RNA, 318 nt, synthetic construct
  misc_feature 1..318: note = derived and/or modified sequence opt4 from Pexelizumab_h5g1.1VHC_+_F_Light_Chain_V-Region
  source 1..318: mol_type = other RNA
gacatccagatgacccagagccccagcctgagcgccagcgtgggcgacagagtgaccatcacctgcggcgccagcgagaacatctacggcgccctgaactggtaccagagaaagcccggcaaggcccccaagctgctgatctacggcgccaccaacctggccgacggcgtgcccagcagattcagcggcagcggcagcggcaccgactacaccctgaccatcagcagcctgcagcccgaggacttcgccacctactactgccagaacgtgctgaacacccccctgaccttcggccagggcaccaaggtggagatcaag

SEQ ID NO: 31260 - RNA, 1326 nt, synthetic construct
  misc_feature 1..1326: note = derived and/or modified sequence opt4 from PF-05082566_HeavyChain1
  source 1..1326: mol_type = other RNA
gaggtgcagctggtgcagagcggcgccgaggtgaagaagcccggcgagagcctgagaatcagctgcaagggcagcggctacagcttcagcacctactggatcagctgggtgagacagatgcccggcaagggcctggagtggatgggcaagatctaccccggcgacagctacaccaactacagccccagcttccagggccaggtgaccatcagcgccgacaagagcatcagcaccgcctacctgcagtggagcagcctgaaggccagcgacaccgccatgtactactgcgccagaggctacggcatcttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31261 - RNA, 642 nt, synthetic construct
  misc_feature 1..642: note = derived and/or modified sequence opt4 from PF-05082568_LightChain1
  source 1..642: mol_type = other RNA
agctacgagctgacccagccccccagcgtgagcgtgagccccggccagaccgccagcatcacctgcagcggcgacaacatcggcgaccagtacgcccactggtaccagcagaagcccggccagagccccgtgctggtgatctaccaggacaagaacagacccagcggcatccccgagagattcagcggcagcaacagcggcaacaccgccaccctgaccatcagcggcacccaggccatggacgaggccgactactactgcgccacctacaccggcttcggcagcctggccgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31262 - RNA, 1341 nt, synthetic construct
  misc_feature 1..1341: note = derived and/or modified sequence opt4 from Pidilizumab_HeavyChain1
  source 1..1341: mol_type = other RNA
caggtgcagctggtgcagagcggcagcgagctgaagaagcccggcgccagcgtgaagatcagctgcaaggccagcggctacaccttcaccaactacggcatgaactgggtgagacaggcccccggccagggcctgcagtggatgggctggatcaacaccgacagcggcgagagcacctacgccgaggagttcaagggcagattcgtgttcagcctggacaccagcgtgaacaccgcctacctgcagatcaccagcctgaccgccgaggacaccggcatgtacttctgcgtgagagtgggctacgacgccctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31263 - RNA, 639 nt, synthetic construct
  misc_feature 1..639: note = derived and/or modified sequence opt4 from Pidilizumab_LightChain1
  source 1..639: mol_type = other RNA
gagatcgtgctgacccagagccccagcagcctgagcgccagcgtgggcgacagagtgaccatcacctgcagcgccagaagcagcgtgagctacatgcactggttccagcagaagcccggcaaggcccccaagctgtggatctacagaaccagcaacctggccagcggcgtgcccagcagattcagcggcagcggcagcggcaccagctactgcctgaccatcaacagcctgcagcccgaggacttcgccacctactactgccagcagagaagcagcttccccctgaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31264 - RNA, 1350 nt, synthetic construct
  misc_feature 1..1350: note = derived and/or modified sequence opt4 from Pinatuzumab_vedotin_HeavyChain1
  source 1..1350: mol_type = other RNA
gaggtgcagctggtggagagcggcggcggcctggtgcagcccggcggcagcctgagactgagctgcgccgccagcggctacgagttcagcagaagctggatgaactgggtgagacaggcccccggcaagggcctggagtgggtgggcagaatctaccccggcgacggcgacaccaactacagcggcaagttcaagggcagattcaccatcagcgccgacaccagcaagaacaccgcctacctgcagatgaacagcctgagagccgaggacaccgccgtgtactactgcgccagagacggcagcagctgggactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31265 - RNA, 657 nt, synthetic construct
  misc_feature 1..657: note = derived and/or modified sequence opt4 from Pinatuzumab_vedotin_LightChain1
  source 1..657: mol_type = other RNA
gacatccagatgacccagagccccagcagcctgagcgccagcgtgggcgacagagtgaccatcacctgcagaagcagccagagcatcgtgcacagcgtgggcaacaccttcctggagtggtaccagcagaagcccggcaaggcccccaagctgctgatctacaaggtgagcaacagattcagcggcgtgcccagcagattcagcggcagcggcagcggcaccgacttcaccctgaccatcagcagcctgcagcccgaggacttcgccacctactactgcttccagggcagccagttcccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31266 - RNA, 1023 nt, synthetic construct
  misc_feature 1..1023: note = derived and/or modified sequence opt4 from Placulumab_chain1
  source 1..1023: mol_type = other RNA
gacatccagatgacccagagccccagcagcctgagcgccagcgtgggcgacagagtgaccatcacctgcagagccagccaggccatcgacagctacctgcactggtaccagcagaagcccggcaaggcccccaagctgctgatctacagcgccagcaacctggagaccggcgtgcccagcagattcagcggcagcggcagcggcaccgacttcaccctgaccatcagcagcctgctgcccgaggacttcgccacctactactgccagcaggtggtgtggagacccttcaccttcggccagggcaccaaggtggagatcaagagagtggagcccaagagcagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31267 - RNA, 1023 nt, synthetic construct; identical to SEQ ID NO: 31266
  misc_feature 1..1023: note = derived and/or modified sequence opt4 from Placulumab_HeavyChain1
  source 1..1023: mol_type = other RNA

SEQ ID NO: 31268 - RNA, 1341 nt, synthetic construct
  misc_feature 1..1341: note = derived and/or modified sequence opt4 from Plozalizumab_HeavyChain1
  source 1..1341: mol_type = other RNA
gaggtgcagctggtggagagcggcggcggcctggtgaagcccggcggcagcctgagactgagctgcgccgccagcggcttcaccttcagcgcctacgccatgaactgggtgagacaggcccccggcaagggcctggagtgggtgggcagaatcagaaccaagaacaacaactacgccacctactacgccgacagcgtgaaggacagattcaccatcagcagagacgacagcaagaacaccctgtacctgcagatgaacagcctgaagaccgaggacaccgccgtgtactactgcaccaccttctacggcaacggcgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31269 - RNA, 657 nt, synthetic construct
  misc_feature 1..657: note = derived and/or modified sequence opt4 from Plozalizumab_LightChain1
  source 1..657: mol_type = other RNA
gacgtggtgatgacccagagccccctgagcctgcccgtgaccctgggccagcccgccagcatcagctgcaagagcagccagagcctgctggacagcgacggcaagaccttcctgaactggttccagcagagacccggccagagccccagaagactgatctacctggtgagcaagctggacagcggcgtgcccgacagattcagcggcagcggcagcggcaccgacttcaccctgaagatcagcagagtggaggccgaggacgtgggcgtgtactactgctggcagggcacccacttcccctacaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31270 - RNA, 1341 nt, synthetic construct
  misc_feature 1..1341: note = derived and/or modified sequence opt4 from Pogalizumab_HeavyChain1
  source 1..1341: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31271 - RNA, 642 nt, synthetic construct
  misc_feature 1..642: note = derived and/or modified sequence opt4 from Pogalizumab_LightChain1
  source 1..642: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggccacaccctgccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31272 - RNA, 1341 nt, synthetic construct
  misc_feature 1..1341: note = derived and/or modified sequence opt4 from Polatuzumab_vedotin_HeavyChain1
  source 1..1341: mol_type = other RNA
gaggtgcagctggtggagagcggcggcggcctggtgcagcccggcggcagcctgagactgagctgcgccgccagcggctacaccttcagcagctactggatcgagtgggtgagacaggcccccggcaagggcctggagtggatcggcgagatcctgcccggcggcggcgacaccaactacaacgagatcttcaagggcagagccaccttcagcgccgacaccagcaagaacaccgcctacctgcagatgaacagcctgagagccgaggacaccgccgtgtactactgcaccagaagagtgcccatcagactggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31273 - RNA, 654 nt, synthetic construct
  misc_feature 1..654: note = derived and/or modified sequence opt4 from Polatuzumab_vedotin_LightChain1
  source 1..654: mol_type = other RNA
gacatccagctgacccagagccccagcagcctgagcgccagcgtgggcgacagagtgaccatcacctgcaaggccagccagagcgtggactacgagggcgacagcttcctgaactggtaccagcagaagcccggcaaggcccccaagctgctgatctacgccgccagcaacctggagagcggcgtgcccagcagattcagcggcagcggcagcggcaccgacttcaccctgaccatcagcagcctgcagcccgaggacttcgccacctactactgccagcagagcaacgaggaccccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31274 - RNA, 1326 nt, synthetic construct
  misc_feature 1..1326: note = derived and/or modified sequence opt4 from Ponezumab_HeavyChain1
  source 1..1326: mol_type = other RNA
caggtgcagctggtgcagagcggcgccgaggtgaagaagcccggcgccagcgtgaaggtgagctgcaaggccagcggctactacaccgaggcctactacatccactgggtgagacaggcccccggccagggcctggagtggatgggcagaatcgaccccgccaccggcaacaccaagtacgcccccagactgcaggacagagtgaccatgaccagagacaccagcaccagcaccgtgtacatggagctgagcagcctgagaagcgaggacaccgccgtgtactactgcgccagcctgtacagcctgcccgtgtactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31275 - RNA, 657 nt, synthetic construct
  misc_feature 1..657: note = derived and/or modified sequence opt4 from Ponezumab_LightChain1
  source 1..657: mol_type = other RNA
gacgtggtgatgacccagagccccctgagcctgcccgtgaccctgggccagcccgccagcatcagctgcaagagcagccagagcctgctgtacagcgacgccaagacctacctgaactggttccagcagagacccggccagagccccagaagactgatctaccagatcagcagactggaccccggcgtgcccgacagattcagcggcagcggcagcggcaccgacttcaccctgaagatcagcagagtggaggccgaggacgtgggcgtgtactactgcctgcagggcacccactaccccgtgctgttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31276 - RNA, 1362 nt, synthetic construct
  misc_feature 1..1362: note = derived and/or modified sequence opt4 from Pritoxaximab_HeavyChain1
  source 1..1362: mol_type = other RNA
caggtgcagctgcaggagagcggcgccgagctggtgagaagcggcgccagcgtgagaatgagctgcaaggccagcggctacaccttcaccagctacaacatgcactgggtgaagcagacccccggccagggcctggagtggatcggctacatctaccccggcaacggcggcaccaactacatccagaagttcaagggcaaggccatcctgaccgccgacaccagcagcagcaccgcctacatgcagatcagcagcctgaccagcgaggacagcgccgtgtacttctgcaccagaagccccagccactacagcagcgacccctacttcgactactggggccagggcaccaccctgaccgtgagcagcgagttcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31277 - RNA, 642 nt, synthetic construct
  misc_feature 1..642: note = derived and/or modified sequence opt4 from Pritoxaximab_LightChain1
  source 1..642: mol_type = other RNA
gacatcgtgatgagccagagccacaagttcatgagcaccagcgtgggcgacagagtgagcatcacctgcaaggccagccaggacgtgggcaccgccgtggcctggtaccagcagaaccccggccagagccccaagttcctgatctactgggccagcaccagacacaccggcgtgcccgacagattcaccggcagcggcagcggcaccgacttcaccctgaccatcaccaacgtgcagagcgaggacctggccgactacttctgccagcagtacagcagctaccccctgaccttcggcgccggcaccagcctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31278 - RNA, 1350 nt, synthetic construct
  misc_feature 1..1350: note = derived and/or modified sequence opt4 from Pritumumab_HeavyChain1
  source 1..1350: mol_type = other RNA
gaggtgcagctgctggagagcggcggcgacctggtgcagcccggcggcagcctgagactgagctgcgccgccagcggcttcaccttcagcaactacgccatgagctgggtgagacaggcccccggcaagggcctggagtgggtgagcgccatcacccccagcggcggcagcaccaactacgccgacagcgtgaagggcagattcaccatcagcagagacaacagccagaacaccctgtacctgcagatgaacagcctgagagtggaggacaccgccgtgtacatctgcggcagagtgccctacagaagcacctggtaccccctgtactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31279 - RNA, 642 nt, synthetic construct
  misc_feature 1..642: note = derived and/or modified sequence opt4 from Pritumumab_LightChain1
  source 1..642: mol_type = other RNA
gacatccagatgacccagagccccagcagcctgagcgccagcgtgggcgacagagtgaccatcacctgcagagccagccaggacatcagcaactacctggcctggttccagcagaagcccggcaaggcccccaagagcctgatctacgccgccagcagcctgcacagcaaggtgcccacccagttcagcggcagcggcagcggcaccgacttcaccctgaccatcagcagcctgcagcccgaggacttcgccacctactactgcctgcagtacagcacctaccccatcaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31280 - RNA, 1341 nt, synthetic construct
  misc_feature 1..1341: note = derived and/or modified sequence opt4 from Quilizumab_HeavyChain1
  source 1..1341: mol_type = other RNA
gaggtgcagctggtggagagcggcggcggcctggtgcagcccggcggcagcctgagactgagctgcgccgccagcggcttcaccttcagcgactacggcatcgcctgggtgagacaggcccccggcaagggcctggagtgggtggccttcatcagcgacctggcctacaccatctactacgccgacaccgtgaccggcagattcaccatcagcagagacaacagcaagaacaccctgtacctgcagatgaacagcctgagagccgaggacaccgccgtgtactactgcgccagagacaactgggacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31281 - RNA, 657 nt, synthetic construct
  misc_feature 1..657: note = derived and/or modified sequence opt4 from Quilizumab_LightChain1
  source 1..657: mol_type = other RNA
gacatccagatgacccagagccccagcagcctgagcgccagcgtgggcgacagagtgaccatcacctgcagaagcagccagagcctggtgcacaacaacgccaacacctacctgcactggtaccagcagaagcccggcaaggcccccaagctgctgatctacaaggtgagcaacagattcagcggcgtgcccagcagattcagcggcagcggcagcggcaccgacttcaccctgaccatcagcagcctgcagcccgaggacttcgccacctactactgcagccagaacaccctggtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31282 - RNA, 1335 nt, synthetic construct
  misc_feature 1..1335: note = derived and/or modified sequence opt4 from Racotumomab_HeavyChain1
  source 1..1335: mol_type = other RNA
caggtgcagctgcagcagagcggcgccgagctggtgaagcccggcgccagcgtgaagctgagctgcaaggccagcggctacaccttcaccagctacgacatcaactgggtgagacagagacccgagcagggcctggagtggatcggctggatcttccccggcgacggcagcaccaagtacaacgagaagttcaagggcaaggccaccctgaccaccgacaagagcagcagcaccgcctacatgcagctgagcagactgaccagcgaggacagcgccgtgtacttctgcgccagagaggactactacgacaacagctactacttcgactactggggccagggcaccaccctgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagccccagacccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctggttcgtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatgaacaccaacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 31283 - RNA, 642 nt, synthetic construct
  misc_feature 1..642: note = derived and/or modified sequence opt4 from Racotumomab_LightChain1
  source 1..642: mol_type = other RNA
gacatccagatgacccagaccaccagcagcctgagcgccagcctgggcgacagagtgaccatcagctgcagagccagccaggacatcagcaactacctgaactggtaccagcagaagcccgacggcaccgtgaagctgctgatctactacaccagcagactgcacagcggcgtgcccagcagattcagcggcagcggcagcggcaccgactacagcctgaccatcagcaacctggagcaggaggacatcgccacctacttctgccagcagggcaacaccctgccctggaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 31284 - RNA, 1089 nt, synthetic construct; identical to SEQ ID NO: 31222
  misc_feature 1..1089: note = derived and/or modified sequence opt4 from Racotumomab_scVH-VH'-VH_chain
  source 1..1089: mol_type = other RNA

SEQ ID NO: 31285 - RNA, 1071 nt, synthetic construct
  misc_feature 1..1071: note = derived and/or modified sequence opt4 from Radretumab_HeavyChain1
  source 1..1071: mol_type = other RNA
gaggtgcagctgctggagagcggcggcggcctggtgcagcccggcggcagcctgagactgagctgcgccgccagcggcttcaccttcagcagcttcagcatgagctgggtgagacaggcccccggcaagggcctggagtgggtgagcagcatcagcggcagcagcggcaccacctactacgccgacagcgtgaagggcagattcaccatcagcagagacaacagcaagaacaccctgtacctgcagatgaacagcctgagagccgaggacaccgccgtgtactactgcgccaagcccttcccctacttcgactactggggccagggcaccctggtgaccgtgagcagcggcgacggcagcagcggcggcagcggcggcgccagcgagatcgtgctgacccagagccccggcaccctgagcctgagccccggcgagagagccaccctgagctgcagagccagccagagcgtgagcagcagcttcctggcctggtaccagcagaagcccggccaggcccccagactgctgatctactacgccagcagcagagccaccggcatccccgacagattcagcggcagcggcagcggcaccgacttcaccctgaccatcagcagactggagcccgaggacttcgccgtgtactactgccagcagaccggcagaatcccccccaccttcggccagggcaccaaggtggagatcaagagcggcggcagcggcggccccagagccgcccccgaggtgtacgccttcgccacccccgagtggcccggcagcagagacaagagaaccctggcctgcctgatccagaacttcatgcccgaggacatcagcgtgcagtggctgcacaacgaggtgcagctgcccgacgccagacacagcaccacccagcccagaaagaccaagggcagcggcttcttcgtgttcagcagactggaggtgaccagagccgagtgggagcagaaggacgagttcatctgcagagccgtgcacgaggccgccagccccagccagaccgtgcagagagccgtgagcgtgaaccccgagagcagcagaagaggcggctgc

SEQ ID NO: 31286 - RNA, 414 nt, synthetic construct; identical to SEQ ID NO: 31237
  misc_feature 1..414: note = derived and/or modified sequence opt4 from Radretumab_j_chain
  source 1..414: mol_type = other RNA

SEQ ID NO: 31287 - RNA, 1368 nt, synthetic construct
  misc_feature 1..1368: note = derived and/or modified sequence opt4 from Rafivirumab_HeavyChain1
  source 1..1368: mol_type = other RNA
caggtgcagctggtgcagagcggcgccgaggtgaagaagcccggcagcagcgtgaaggtgagctgcaaggccagcggcggcaccttcaacagatacaccgtgaactgggtgagacaggcccccggccagggcctggagtggatgggcggcatcatccccatcttcggcaccgccaactacgcccagagattccagggcagactgaccatcaccgccgacgagagcaccagcaccgcctacatggagctgagcagcctgagaagcgacgacaccgccgtgtacttctgcgccagagagaacctggacaacagcggcacctactactacttcagcggctggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31288 - RNA, 1368 nt, synthetic construct
  misc_feature 1..1368: note = derived and/or modified sequence opt4 from Rafivirumab_HeavyChain
  source 1..1368: mol_type = other RNA
gaggtgcagctggtgcagagcggcgccgaggtgaagaagcccggcagcagcgtgaaggtgagctgcaaggccagcggcggcaccttcaacagatacaccgtgaactgggtgagacaggcccccggccagggcctggagtggatgggcggcatcatccccatcttcggcaccgccaactacgcccagagattccagggcagactgaccatcaccgccgacgagagcaccagcaccgcctacatggagctgagcagcctgagaagcgacgacaccgccgtgtacttctgcgccagagagaacctggacaacagcggcacctactactacttcagcggctggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31289 - RNA, 654 nt, synthetic construct
  misc_feature 1..654: note = derived and/or modified sequence opt4 from Rafivirumab_LightChain1
  source 1..654: mol_type = other RNA
cagagcgccctgacccagcccagaagcgtgagcggcagccccggccagagcgtgaccatcagctgcaccggcaccagcagcgacatcggcggctacaacttcgtgagctggtaccagcagcaccccggcaaggcccccaagctgatgatctacgacgccaccaagagacccagcggcgtgcccgacagattcagcggcagcaagagcggcaacaccgccagcctgaccatcagcggcctgcaggccgaggacgaggccgactactactgctgcagctacgccggcgactacacccccggcgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31290 - RNA, 654 nt, synthetic construct
  misc_feature 1..654: note = derived and/or modified sequence opt4 from Rafivirumab_LightChain
  source 1..654: mol_type = other RNA
gagagcgccctgacccagcccagaagcgtgagcggcagccccggccagagcgtgaccatcagctgcaccggcaccagcagcgacatcggcggctacaacttcgtgagctggtaccagcagcaccccggcaaggcccccaagctgatgatctacgacgccaccaagagacccagcggcgtgcccgacagattcagcggcagcaagagcggcaacaccgccagcctgaccatcagcggcctgcaggccgaggacgaggccgactactactgctgcagctacgccggcgactacacccccggcgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31291 - RNA, 1332 nt, synthetic construct
  misc_feature 1..1332: note = derived and/or modified sequence opt4 from Ralpancizumab_HeavyChain1
  source 1..1332: mol_type = other RNA
caggtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatgggcgagatccaccccagcggcggcagaaccaactacaacgagaagttcaagagcagagtgaccatgaccagagacaccagcaccagcaccgtgtacatggagctgagcagcctgagaagcgaggacaccgccgtgtactactgcgccagagagagacccctgtacgccagcgacctgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31292 - RNA, 642 nt, synthetic construct
  misc_feature 1..642: note = derived and/or modified sequence opt4 from Ralpancizumab_LightChain1
  source 1..642: mol_type = other RNA
gacatccagatgacccagagccccagcagcctgagcgccagcgtgggcgacagagtgaccatcacctgcaaggccagccaggacgtgcacaccgccgtggcctggtaccagcagaagcccggcaaggcccccaagctgctgatctaccacgccagctacagatacaccggcgtgcccagcagattcagcggcagcggcagcggcaccgacttcaccttcaccatcagcagcctgcagcccgaggacatcgccacctactactgccagcagagatacagcctgtggagaaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31293 - RNA, 1338 nt, synthetic construct
  misc_feature 1..1338: note = derived and/or modified sequence opt4 from Ramucirumab_HeavyChain1
  source 1..1338: mol_type = other RNA
gaggtgcagctggtgcagagcggcggcggcctggtgaagcccggcggcagcctgagactgagctgcgccgccagcggcttcaccttcagcagctacagcatgaactgggtgagacaggcccccggcaagggcctggagtgggtgagcagcatcagcagcagcagcagctacatctactacgccgacagcgtgaagggcagattcaccatcagcagagacaacgccaagaacagcctgtacctgcagatgaacagcctgagagccgaggacaccgccgtgtactactgcgccagagtgaccgacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31294 - RNA, 642 nt, synthetic construct
  misc_feature 1..642: note = derived and/or modified sequence opt4 from Ramucirumab_LightChain1
  source 1..642: mol_type = other RNA
gacatccagatgacccagagccccagcagcgtgagcgccagcatcggcgacagagtgaccatcacctgcagagccagccagggcatcgacaactggctgggctggtaccagcagaagcccggcaaggcccccaagctgctgatctacgacgccagcaacctggacaccggcgtgcccagcagattcagcggcagcggcagcggcacctacttcaccctgaccatcagcagcctgcaggccgaggacttcgccgtgtacttctgccagcaggccaaggccttcccccccaccttcggcggcggcaccaaggtggacatcaagggcaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31295 - RNA, 687 nt, synthetic construct
  misc_feature 1..687: note = derived and/or modified sequence opt4 from Ranibiziuab_HeavyChain1
  source 1..687: mol_type = other RNA
gaggtgcagctggtggagagcggcggcggcctggtgcagcccggcggcagcctgagactgagctgcgccgccagcggctacgacttcacccactacggcaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagaacagcctgagagccgaggacaccgccgtgtactactgcgccaagtacccctactactacggcaccagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacctg

SEQ ID NO: 31296 - RNA, 642 nt, synthetic construct
  misc_feature 1..642: note = derived and/or modified sequence opt4 from Ranibiziuab_LightChain1
  source 1..642: mol_type = other RNA
gacatccagctgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31297 - RNA, 639 nt, synthetic construct
  misc_feature 1..639: note = derived and/or modified sequence opt4 from Ranibizumab_fab_fragment
  source 1..639: mol_type = other RNA
gacatccagctgacccagagccccagcagcctgagcgccagcgtgggcgacagagtgaccatcacctgcagcgccagccaggacatcagcaactacctgaactggtaccagcagaagcccggcaaggcccccaaggtgctgatctacttcaccagcagcctgcacagcggcgtgcccagcagattcagcggcagcggcagcggcaccgacttcaccctgaccatcagcagcctgcagcccgaggacttcgccacctactactgccagcagtacagcaccgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgag

SEQ ID NO: 31298 - RNA, 693 nt, synthetic construct
  misc_feature 1..693: note = derived and/or modified sequence opt4 from Ranibizumab_HeavyChain
  source 1..693: mol_type = other RNA
gaggtgcagctggtggagagcggcggcggcctggtgcagcccggcggcagcctgagactgagctgcgccgccagcggctacgacttcacccactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccctactactacggcaccagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacctg

SEQ ID NO: 31299 - RNA, 654 nt, synthetic construct
  misc_feature 1..654: note = derived and/or modified sequence opt4 from Ranibizumab_LightChain
  source 1..654: mol_type = other RNA
gaggtgcagctggtggagagcggcggcggcctggtgcagcccggcggcagcctgagactgagctgcgccgccagcggctacgacttcacccactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccctactactacggcaccagccactggtacttcgacgtgtggggccagggcaccctggtgaccgtgagcagcgccagcaccaagggccccagcgtgttccccctggcccccagcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 31300 - RNA, 642 nt, synthetic construct; identical to SEQ ID NO: 31296
  misc_feature 1..642: note = derived and/or modified sequence opt4 from Ranibizumab_LightChain_variant
  source 1..642: mol_type = other RNA

SEQ ID NO: 31301 - RNA, 1368 nt, synthetic construct
  misc_feature 1..1368: note = derived and/or modified sequence opt4 from Refanezumab_HeavyChain1
  source 1..1368: mol_type = other RNA
caggtgcagctggtgcagagcggcagcgagctgaagaagcccggcgccagcgtgaaggtgagctgcaaggccagcggctacaccttcaccaactacggcatgaactgggtgagacaggcccccggccagggcctggagtggatgggctggatcaacacctacaccggcgagcccacctacgccgacgacttcaccggcagattcgtgttcagcctggacaccagcgtgagcaccgcctacctgcagatcagcagcctgaaggccgaggacaccgccgtgtactactgcgccagaaaccccatcaactactacggcatcaactacgagggctacgtgatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31302 - RNA, 657 nt, synthetic construct
  misc_feature 1..657: note = derived and/or modified sequence opt4 from Refanezumab_LightChain1
  source 1..657: mol_type = other RNA
gacatcgtgatgacccagagccccgacagcctggccgtgagcctgggcgagagagccaccatcaactgcaagagcagccacagcgtgctgtacagcagcaaccagaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccaccagtacctgagcagcctgaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31303 - RNA, 1314 nt, synthetic construct
  misc_feature 1..1314: note = derived and/or modified sequence opt4 from REGN2810_HeavyChain1
  source 1..1314: mol_type = other RNA
gaggtgcagctgctggagagcggcggcgtgctggtgcagcccggcggcagcctgagactgagctgcgccgccagcggcttcaccttcagcaacttcggcacctgggtgagacaggcccccggcaagggcctggagtgggtgagcggcatcagcggcggcggcagagacacctacttcgccgacagcgtgaagggcagattcaccatcagcagagacaacagcaagaacaccctgtacctgcagaacagcctgaagggcgaggacaccgccgtgtactactgcgtgaagtggggcaacatctacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgcacgaggccctgcacaaccactacacccagaagagcctgagcctgagcctgggc

SEQ ID NO: 31304 - RNA, 639 nt, synthetic construct
  misc_feature 1..639: note = derived and/or modified sequence opt4 from REGN2810_LightChain1
  source 1..639: mol_type = other RNA
gacatccagacccagagccccagcagcctgagcgccagcgtgggcgacagcatcaccatcacctgcagagccagcctgagcatcaacaccttcctgaactggtaccagcagaagcccggcaaggcccccaacctgctgatctacgccgccagcagcctgcacggcggcgtgcccagcagattcagcggcagcggcagcggcaccgacttcaccctgaccatcagaaccctgcagcccgaggacttcgccacctactactgccagcagagcagcaacacccccttcaccttcggccccggcaccgtggtggacttcagaagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31305 - RNA, 651 nt, synthetic construct
  misc_feature 1..651: note = derived and/or modified sequence opt4 from rhuMab_HER2(9CI)_LightChain
  source 1..651: mol_type = other RNA
gtgcacagcgacatccagatgacccagagccccagcagcctgagcgccagcgtgggcgacagagtgaccatcacctgcaaggccagccaggacgtgagcatcggcgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagtactacatctacccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31306 - RNA, 1215 nt, synthetic construct
  misc_feature 1..1215: note = derived and/or modified sequence opt4 from rhuMab_HER2_HeavyChain
  source 1..1215: mol_type = other RNA
gaggtgcagctggtggagagcggcggcggcctggtgcagcccggcggcagcctgagactgagctgcgccgccagcggcttcaccttcaccgactacaccatggactgggtgagacaggcccccggcaagggcctgaccgccgtgtactactgcgccagaaacctgggccccagcttctacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggccccaag

SEQ ID NO: 31307 - RNA, 645 nt, synthetic construct
  misc_feature 1..645: note = derived and/or modified sequence opt4 from rhuMab_HER2_LightChain
  source 1..645: mol_type = other RNA
agcgacatccagatgacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31308 - RNA, 318 nt, synthetic construct
  misc_feature 1..318: note = derived and/or modified sequence opt4 from rhuMab_HER2_LightChain_variant1
  source 1..318: mol_type = other RNA
accgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31309 - RNA, 642 nt, synthetic construct
  misc_feature 1..642: note = derived and/or modified sequence opt4 from rhuMab_HER2_LightChain_variant2
  source 1..642: mol_type = other RNA
gacatccagatgacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaagagaacctgcgccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31310 - RNA, 642 nt, synthetic construct
  misc_feature 1..642: note = derived and/or modified sequence opt4 from rhuMab_HER2_LightChain_variant3
  source 1..642: mol_type = other RNA
gacatccagatgacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31311 - RNA, 645 nt, synthetic construct; identical to SEQ ID NO: 31307
  misc_feature 1..645: note = derived and/or modified sequence opt4 from rhuMab_HER2_LightChain_variant4
  source 1..645: mol_type = other RNA

SEQ ID NO: 31312 - RNA, 321 nt, synthetic construct
  misc_feature 1..321: note = derived and/or modified sequence opt4 from rhuMab_HER2_LightChain_V-Region
  source 1..321: mol_type = other RNA
gacatccagatgacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaag

SEQ ID NO: 31313 - RNA, 1350 nt, synthetic construct
  misc_feature 1..1350: note = derived and/or modified sequence opt4 from rhuMab_HER2_gamma1-Chain
  source 1..1350: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31314 - RNA, 1350 nt, synthetic construct
  misc_feature 1..1350: note = derived and/or modified sequence opt4 from rhuMab_HER2__gamma1-Chain
  source 1..1350: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagctgcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31315 - RNA, 729 nt, synthetic construct
  misc_feature 1..729: note = derived and/or modified sequence opt4 from rhuMab_HER2_gamma1-Chain__rhuMab_HER2_LightChain_sc4D5
  source 1..729: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcggcggcggcggcagcggcggcggcggcagcggcggcggcggcagcgacatccagatgacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaagaga

SEQ ID NO: 31316 - RNA, 1350 nt, synthetic construct; identical to SEQ ID NO: 31313
  misc_feature 1..1350: note = derived and/or modified sequence opt4 from rhuMab_HER2_gamma1-Chain_variant1
  source 1..1350: mol_type = other RNA

SEQ ID NO: 31317 - RNA, 1350 nt, synthetic construct; identical to SEQ ID NO: 31314
  misc_feature 1..1350: note = derived and/or modified sequence opt4 from rhuMab_HER2_gamma1-Chain_variant2
  source 1..1350: mol_type = other RNA

SEQ ID NO: 31318 - RNA, 1350 nt, synthetic construct
  misc_feature 1..1350: note = derived and/or modified sequence opt4 from rhuMab_HER2_gamma1-Chain_variant3
  source 1..1350: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagatgcgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31319 - RNA, 360 nt, synthetic construct
  misc_feature 1..360: note = derived and/or modified sequence opt4 from rhuMab_HER2_gamma1-Chain_V-Region
  source 1..360: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagc

SEQ ID NO: 31320 - RNA, 1359 nt, synthetic construct; identical to SEQ ID NO: 30651
  misc_feature 1..1359: note = derived and/or modified sequence opt4 from rhuMAb-VEGF_HeavyChain1
  source 1..1359: mol_type = other RNA

SEQ ID NO: 31321 - RNA, 642 nt, synthetic construct; identical to SEQ ID NO: 30652
  misc_feature 1..642: note = derived and/or modified sequence opt4 from rhuMAb-VEGF_LightChain1
  source 1..642: mol_type = other RNA

SEQ ID NO: 31322 - RNA, 642 nt, synthetic construct; identical to SEQ ID NO: 30652
  misc_feature 1..642: note = derived and/or modified sequence opt4 from rhuMAb-VEGF_LightChain
  source 1..642: mol_type = other RNA

SEQ ID NO: 31323 - RNA, 321 nt, synthetic construct; identical to SEQ ID NO: 30661
  misc_feature 1..321: note = derived and/or modified sequence opt4 from rhuMAb-VEGF_LightChain__VG-Region
  source 1..321: mol_type = other RNA

SEQ ID NO: 31324 - RNA, 1359 nt, synthetic construct; identical to SEQ ID NO: 30651
  misc_feature 1..1359: note = derived and/or modified sequence opt4 from rhuMAb-VEGF_gamma1-Chain
  source 1..1359: mol_type = other RNA

SEQ ID NO: 31325 - RNA, 369 nt, synthetic construct; identical to SEQ ID NO: 30656
  misc_feature 1..369: note = derived and/or modified sequence opt4 from rhuMAb-VEGF_gamma1-Chain_VDG-Region
  source 1..369: mol_type = other RNA

SEQ ID NO: 31326 - RNA, 1338 nt, synthetic construct
  misc_feature 1..1338: note = derived and/or modified sequence opt4 from Rilotumumab_HeavyChain1
  source 1..1338: mol_type = other RNA
caggtgcagctgcaggagagcggccccggcctggtgaagcccagcgagaccctgagcctgacctgcaccgtgagcggcggcagcatcagcatctactactggagctggatcagacagccccccggcaagggcctggagtggatcggctacgtgtactacagcggcagcaccaactacaaccccagcctgaagagcagagtgaccatcagcgtggacaccagcaagaaccagttcagcctgaagctgaacagcgtgaccgccgccgacaccgccgtgtactactgcgccagaggcggctacgacttctggagcggctacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31327 - RNA, 645 nt, synthetic construct
  misc_feature 1..645: note = derived and/or modified sequence opt4 from Rilotumumab_LightChain1
  source 1..645: mol_type = other RNA
gagatcgtgatgacccagagccccgccaccctgagcgtgagccccggcgagagagccaccctgagctgcagagccagccagagcgtggacagcaacctggcctggtacagacagaagcccggccaggcccccagactgctgatctacggcgccagcaccagagccaccggcatccccgccagattcagcggcagcggcagcggcaccgagttcaccctgaccatcagcagcctgcagagcgaggacttcgccgtgtactactgccagcagtacatcaactggccccccatcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31328 - RNA, 1071 nt, synthetic construct; identical to SEQ ID NO: 31285
  misc_feature 1..1071: note = derived and/or modified sequence opt4 from Rilotumumab_scFv-CH_chain
  source 1..1071: mol_type = other RNA

SEQ ID NO: 31329 - RNA, 1347 nt, synthetic construct
  misc_feature 1..1347: note = derived and/or modified sequence opt4 from Rinucumab_HeavyChain1
  source 1..1347: mol_type = other RNA
cagctgcagctgcaggagagcggccccggcctggtgaagcccagcgagaccctgagcctgacctgcaccgtgagcggcggcagcatcaccagcagcagctactactggggctggatcagacagccccccggcaagggcctggagtggatcggcagcatctactacagaggcagcaccaactacaaccccagcctgaagagcagagtgaccatcagcgtggacagcagcaagaaccagttctacctgaaggtgagcagcgtgaccgccgtggacaccgccgtgtactactgcgccagacagaacggcgccgccagacccagctggttcgacccctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31330 - RNA, 1344 nt, synthetic construct
  misc_feature 1..1344: note = derived and/or modified sequence opt4 from Rinucumab_HeavyChain
  source 1..1344: mol_type = other RNA
cagctgcagctgcaggagagcggccccggcctggtgaagcccagcgagaccctgagcctgacctgcaccgtgagcggcggcagcatcaccagcagcagctactactggggctggatcagacagccccccggcaagggcctggagtggatcggcagcatctactacagaggcagcaccaactacaaccccagcctgaagagcagagtgaccatcagcgtggacagcagcaagaaccagttctacctgaaggtgagcagcgtgaccgccgtggacaccgccgtgtactactgcgccagacagaacggcgccgccagacccagctggttcgacccctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 31331 - RNA, 645 nt, synthetic construct
  misc_feature 1..645: note = derived and/or modified sequence opt4 from Rinucumab_LightChain1
  source 1..645: mol_type = other RNA
gagatcgtgctgacccagagccccgacaccatcagcctgagccccggcgagagagccaccctgagctgcagagccagccagagcatcagcagcatctacctggcctggtaccagcagaagcccggccaggcccccagactgctgatctacggcgccagcagcagagtgaccggcatccccgacagattcagcgtgagcggcagcggcaccgacttcaccctgaccatcagcagactggagcccgaggacttcgccgtgtactactgccagcactacggcatcagccccttcaccttcggccccggcaccaaggtggacatcagaagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31332 - RNA, 1347 nt, synthetic construct
  misc_feature 1..1347: note = derived and/or modified sequence opt4 from Risankizumab_HeavyChain1
  source 1..1347: mol_type = other RNA
caggtgcagctggtgcagagcggcgccgaggtgaagaagcccggcagcagcgtgaaggtgagctgcaaggccagcggctacaccttcaccgaccagaccatccactggatgagacaggcccccggccagggcctggagtggatcggctacatctaccccagagacgacagccccaagtacaacgagaacttcaagggcaaggtgaccatcaccgccgacaagagcaccagcaccgcctacatggagctgagcagcctgagaagcgaggacaccgccgtgtactactgcgccatccccgacagaagcggctacgcctggttcatctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31333 - RNA, 642 nt, synthetic construct
  misc_feature 1..642: note = derived and/or modified sequence opt4 from Risankizumab_LightChain1
  source 1..642: mol_type = other RNA
gacatccagatgacccagagccccagcagcctgagcgccagcgtgggcgacagagtgaccatcacctgcaaggccagcagagacgtggccatcgccgtggcctggtaccagcagaagcccggcaaggtgcccaagctgctgatctactgggccagcaccagacacaccggcgtgcccagcagattcagcggcagcggcagcagaaccgacttcaccctgaccatcagcagcctgcagcccgaggacgtggccgactacttctgccaccagtacagcagctaccccttcaccttcggcagcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31334 - RNA, 1353 nt, synthetic construct
  misc_feature 1..1353: note = derived and/or modified sequence opt4 from Rituximab_HeavyChain
  source 1..1353: mol_type = other RNA
caggtgcagctgcagcagcccggcgccgagctggtgaagcccggcgccagcgtgaagatgagctgcaaggccagcggctacaccttcaccagctacaacatgcactgggtgaagcagacccccggcagaggcctggagtggatcggcgccatctaccccggcaacggcgacaccagctacaaccagaagttcaagggcaaggccaccctgaccgccgacaagagcagcagcaccgcctacatgcagctgagcagcctgaccagcgaggacagcgccgtgtactactgcgccagaagcacctactacggcggcgactggtacttcaacgtgtggggcgccggcaccaccgtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31335 - RNA, 1353 nt, synthetic construct
  misc_feature 1..1353: note = derived and/or modified sequence opt4 from Rituximab_HeavyChain_variant
  source 1..1353: mol_type = other RNA
caggtgcagctgcagcagcccggcgccgagctggtgaagcccggcgccagcgtgaagatgagctgcaaggccagcggctacaccttcaccagctacaacatgcactgggtgaagcagacccccggcagaggcctggagtggatcggcgccatctaccccggcaacggcgacaccagctacaaccagaagttcaagggcaaggccaccctgaccgccgacaagagcagcagcaccgcctacatgcagctgagcagcctgaccagcgaggacagcgccgtgtactactgcgccagaagcacctactacggcggcgactggtacttcaacgtgtggggcgccggcaccaccgtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31336 - RNA, 639 nt, synthetic construct
  misc_feature 1..639: note = derived and/or modified sequence opt4 from Rituximab_LightChain
  source 1..639: mol_type = other RNA
cagatcgtgctgagccagagccccgccatcctgagcgccagccccggcgagaaggtgaccatgacctgcagagccagcagcagcgtgagctacatccactggttccagcagaagcccggcagcagccccaagccctggatctacgccaccagcaacctggccagcggcgtgcccgtgagattcagcggcagcggcagcggcaccagctacagcctgaccatcagcagagtggaggccgaggacgccgccacctactactgccagcagtggaccagcaacccccccaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31337 - RNA, 714 nt, synthetic construct
  misc_feature 1..714: note = derived and/or modified sequence opt4 from Rivabazumab_pegol_HeavyChain1
  source 1..714: mol_type = other RNA
gaggtgcagctggtggagagcggcggcggcgtggtgcagcccggcagaagcctgagactgagctgcgccgccagcggcttcaccttcagcaactaccccatgcactgggtgagacaggcccccggcaagggcctggagtgggtggccgtgatcagctacgacggcagcgagaagtggtacgccgacagcgtgaagggcagattcaccatcagcagagacaacagcaagaacaccctgtacctggagatgaacagcctgagacccgaggacaccgccgtgtactactgcgccagaaacagaggcgacatctactacgacttcacctacgccatggacatctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagcagcgacaagacccacacctgccccccctgccccgcc

SEQ ID NO: 31338 - RNA, 642 nt, synthetic construct
  misc_feature 1..642: note = derived and/or modified sequence opt4 from Rivabazumab_pegol_LightChain1
  source 1..642: mol_type = other RNA
gacatccagctgacccagagccccagcaccctgagcgccagcgtgggcgacagcgtgaccatcacctgcagagccagcgagggcgtggacagatggctggcctggtaccagcagaagcccggcagagcccccaagctgctgatctacgacgccagcaccctgcagagcggcgtgcccagcagattcagcggcagcggcagcggcaccgagttcagcctgaccatcagcagcctgcagcccgacgacgtggccacctactactgccagcacttctggggcaccccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagagc

SEQ ID NO: 31339 - RNA, 1344 nt, synthetic construct
  misc_feature 1..1344: note = derived and/or modified sequence opt4 from Robatumumab_HeavyChain1
  source 1..1344: mol_type = other RNA
gaggtgcagctggtgcagagcggcggcggcctggtgaagcccggcggcagcctgagactgagctgcgccgccagcggcttcaccttcagcagcttcgccatgcactgggtgagacaggcccccggcaagggcctggagtggatcagcgtgatcgacaccagaggcgccacctactacgccgacagcgtgaagggcagattcaccatcagcagagacaacgccaagaacagcctgtacctgcagatgaacagcctgagagccgaggacaccgccgtgtactactgcgccagactgggcaacttctactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31340 - RNA, 642 nt, synthetic construct
  misc_feature 1..642: note = derived and/or modified sequence opt4 from Robatumumab_LightChain1
  source 1..642: mol_type = other RNA
gagatcgtgctgacccagagccccggcaccctgagcgtgagccccggcgagagagccaccctgagctgcagagccagccagagcatcggcagcagcctgcactggtaccagcagaagcccggccaggcccccagactgctgatcaagtacgccagccagagcctgagcggcatccccgacagattcagcggcagcggcagcggcaccgacttcaccctgaccatcagcagactggagcccgaggacttcgccgtgtactactgccaccagagcagcagactgccccacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31341 - RNA, 1368 nt, synthetic construct
  misc_feature 1..1368: note = derived and/or modified sequence opt4 from Roledumab_HeavyChain1
  source 1..1368: mol_type = other RNA
caggtgcagctggtggagagcggcggcggcgtggtgcagcccggcagaagcctgagactgagctgcaccgccagcggcttcaccttcaagaactacgccatgcactgggtgagacaggcccccgccaagggcctggagtgggtggccaccatcagctacgacggcagaaacatccagtacgccgacagcgtgaagggcagattcaccttcagcagagacaacagccaggacaccctgtacctgcagctgaacagcctgagacccgaggacaccgccgtgtactactgcgccagacccgtgagaagcagatggctgcagctgggcctggaggacgccttccacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31342 - RNA, 642 nt, synthetic construct
  misc_feature 1..642: note = derived and/or modified sequence opt4 from Roledumab_LightChain1
  source 1..642: mol_type = other RNA
gccatcagaatgacccagagccccagcagcttcagcgccagcaccggcgacagagtgaccatcacctgcagagccagccaggacatcagaaactacgtggcctggtaccagcagaagagcggcaaggcccccaagttcctgatctacgccgccagcaccctgcagagcggcgtgcccagcagattcagcggcagcggcagcggcaccgacttcaccctgaccatcaacagcctgcagagcgaggacttcgccacctactactgccagcagtactacaacagcccccccaccttcggccagggcaccagagtggagatcaccagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31343 - RNA, 639 nt, synthetic construct; identical to SEQ ID NO: 31297
  misc_feature 1..639: note = derived and/or modified sequence opt4 from Romosozumab_fab_fragment
  source 1..639: mol_type = other RNA

SEQ ID NO: 31344 - RNA, 1347 nt, synthetic construct
  misc_feature 1..1347: note = derived and/or modified sequence opt4 from Romosozumab_HeavyChain1
  source 1..1347: mol_type = other RNA
gaggtgcagctggtgcagagcggcgccgaggtgaagaagcccggcgccagcgtgaaggtgagctgcaaggccagcggctacaccttcaccgactacaacatgcactgggtgagacaggcccccggccagggcctggagtggatgggcgagatcaaccccaacagcggcggcgccggctacaaccagaagttcaagggcagagtgaccatgaccaccgacaccagcaccagcaccgcctacatggagctgagaagcctgagaagcgacgacaccgccgtgtactactgcgccagactgggctacgacgacatctacgacgactggtacttcgacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31345 - RNA, 642 nt, synthetic construct
  misc_feature 1..642: note = derived and/or modified sequence opt4 from Romosozumab_LightChain1
  source 1..642: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgctgagcggcgtgcccagcagattcagcggcagcggcagcggcaccgacttcaccctgaccatcagcagcctgcagcccgaggacttcgccacctactactgccagcagggcgacaccctgccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31346 - RNA, 1326 nt, synthetic construct
  misc_feature 1..1326: note = derived and/or modified sequence opt4 from Rontalizuab_HeavyChain1
  source 1..1326: mol_type = other RNA
gaggtgcagctggtggagagcggcggcggcctggtgcagcccggcggcagcctgagactgagctgcgccaccagcggctacaccttcaccgagtacatcatccactgggtgagacaggcccccggcaagggcctggagtgggtggccagcatcaaccccgactacgacatcaccaactacaaccagagattcaagggcagattcaccatcagcctggacaagagcaagagaaccgcctacctgcagaacagcctgagagccgaggacaccgccgtgtactactgcgccagctggatcagcgacttcttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 31347 - RNA, 648 nt, synthetic construct
  misc_feature 1..648: note = derived and/or modified sequence opt4 from Rontalizuab_LightChain1
  source 1..648: mol_type = other RNA
gacatccagacccagagccccagcagcctgagcgccagcgtgggcgacagagtgaccatcacctgcagagccagccagagcgtgagcaccagcagctacagctaccactggtaccagcagaagcccggcaaggcccccaaggtgctgatcagctacgccagcaacctggagagcggcgtgcccagcagattcagcggcagcggcagcggcaccgacttcaccctgaccatcagcagcctgcagcccgaggacttcgccacctactactgccagcacagctggggcatccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31348 - RNA, 1341 nt, synthetic construct
  misc_feature 1..1341: note = derived and/or modified sequence opt4 from Rontalizumab_HeavyChain1
  source 1..1341: mol_type = other RNA
gaggtgcagctggtggagagcggcggcggcctggtgcagcccggcggcagcctgagactgagctgcgccaccagcggctacaccttcaccgagtacatcatccactgggtgagacaggcccccggcaagggcctggagtgggtggccagcatcaaccccgactacgacatcaccaactacaaccagagattcaagggcagattcaccatcagcctggacaagagcaagagaaccgcctacctgcagatgaacagcctgagagccgaggacaccgccgtgtactactgcgccagctggatcagcgacttcttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31349 - RNA, 654 nt, synthetic construct
  misc_feature 1..654: note = derived and/or modified sequence opt4 from Rontalizumab_LightChain1
  source 1..654: mol_type = other RNA
gacatccagatgacccagagccccagcagcctgagcgccagcgtgggcgacagagtgaccatcacctgcagagccagccagagcgtgagcaccagcagctacagctacatgcactggtaccagcagaagcccggcaaggcccccaaggtgctgatcagctacgccagcaacctggagagcggcgtgcccagcagattcagcggcagcggcagcggcaccgacttcaccctgaccatcagcagcctgcagcccgaggacttcgccacctactactgccagcacagctggggcatccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31350 - RNA, 1341 nt, synthetic construct
  misc_feature 1..1341: note = derived and/or modified sequence opt4 from Rovalpituzumab_tesirine_HeavyChain1
  source 1..1341: mol_type = other RNA
caggtgcagctggtgcagagcggcgccgaggtgaagaagcccggcgccagcgtgaaggtgagctgcaaggccagcggctacaccttcaccaactacggcatgaactgggtgagacaggcccccggccagggcctggagtggatgggctggatcaacacctacaccggcgagcccacctacgccgacgacttcaagggcagagtgaccatgaccaccgacaccagcaccagcaccgcctacatggagctgagaagcctgagaagcgacgacaccgccgtgtactactgcgccagaatcggcgacagcagccccagcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31351 - RNA, 642 nt, synthetic construct
  misc_feature 1..642: note = derived and/or modified sequence opt4 from Rovalpituzumab_tesirine_LightChain1
  source 1..642: mol_type = other RNA
gagatcgtgatgacccagagccccgccaccctgagcgtgagccccggcgagagagccaccctgagctgcaaggccagccagagcgtgagcaacgacgtggtgtggtaccagcagaagcccggccaggcccccagactgctgatctactacgccagcaacagatacaccggcatccccgccagattcagcggcagcggcagcggcaccgagttcaccctgaccatcagcagcctgcagagcgaggacttcgccgtgtactactgccagcaggactacaccagcccctggaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31352 - RNA, 1341 nt, synthetic construct
  misc_feature 1..1341: note = derived and/or modified sequence opt4 from Rovelizumab_HeavyChain1
  source 1..1341: mol_type = other RNA
caggtgcagctggtgcagagcggcgccgaggtgaagaagcccggcgccagcgtgaaggtgagctgcaaggccagcggctacaccttcaccaacaactggatgcagtgggtgagacaggcccccggccagggcctggagtggatgggcgccatcttccccggcgacgacgagaccagatacacccagaagttcagaggcaaggccaccatcaccgccgacaccagcaccagcaccgcctacatggagctgagcagcctgagaagcgaggacaccgccgtgtactactgcggcagaggcggcaagctgagacccttcgccctggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31353 - RNA, 654 nt, synthetic construct
  misc_feature 1..654: note = derived and/or modified sequence opt4 from Rovelizumab_LightChain1
  source 1..654: mol_type = other RNA
gacatccagatgacccagagccccagcagcctgagcgccagcgtgggcgacagagtgaccatcacctgcagagccagcgagagcgtggagagctacggcaacaacttcatgtactggtaccagcagaagcccggcaaggcccccaagctgctgatctacctggccagcaacctggagagcggcgtgcccagcagattcagcggcagcggcagcggcaccgacttcaccctgaccatcagcagcctgcagcccgaggacttcgccacctactactgccaccaggacaacgaggacccccccaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31354 - RNA, 1341 nt, synthetic construct
  misc_feature 1..1341: note = derived and/or modified sequence opt4 from Ruplizumab_HeavyChain1
  source 1..1341: mol_type = other RNA
caggtgcagctggtgcagagcggcgccgaggtggtgaagcccggcgccagcgtgaagctgagctgcaaggccagcggctacatcttcaccagctactacatgtactgggtgaagcaggcccccggccagggcctggagtggatcggcgagatcaaccccagcaacggcgacaccaacttcaacgagaagttcaagagcaaggccaccctgaccgtggacaagagcgccagcaccgcctacatggagctgagcagcctgagaagcgaggacaccgccgtgtactactgcaccagaagcgacggcagaaacgacatggacagctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31355 - RNA, 654 nt, synthetic construct
  misc_feature 1..654: note = derived and/or modified sequence opt4 from Ruplizumab_LightChain1
  source 1..654: mol_type = other RNA
gacatcgtgctgacccagagccccgccaccctgagcgtgagccccggcgagagagccaccatcagctgcagagccagccagagagtgagcagcagcacctacagctacatgcactggtaccagcagaagcccggccagccccccaagctgctgatcaagtacgccagcaacctggagagcggcgtgcccgccagattcagcggcagcggcagcggcaccgacttcaccctgaccatcagcagcgtggagcccgaggacttcgccacctactactgccagcacagctgggagatcccccccaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31356 - RNA, 1353 nt, synthetic construct
  misc_feature 1..1353: note = derived and/or modified sequence opt4 from Sacituzumab_govitecan_HeavyChain1
  source 1..1353: mol_type = other RNA
caggtgcagctgcagcagagcggcagcgagctgaagaagcccggcgccagcgtgaaggtgagctgcaaggccagcggctacaccttcaccaactacggcatgaactgggtgaagcaggcccccggccagggcctgaagtggatgggctggatcaacacctacaccggcgagcccacctacaccgacgacttcaagggcagattcgccttcagcctggacaccagcgtgagcaccgcctacctgcagatcagcagcctgaaggccgacgacaccgccgtgtacttctgcgccagaggcggcttcggcagcagctactggtacttcgacgtgtggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31357 - RNA, 642 nt, synthetic construct
  misc_feature 1..642: note = derived and/or modified sequence opt4 from Sacituzumab_govitecan_LightChain1
  source 1..642: mol_type = other RNA
gacatccagctgacccagagccccagcagcctgagcgccagcgtgggcgacagagtgagcatcacctgcaaggccagccaggacgtgagcatcgccgtggcctggtaccagcagaagcccggcaaggcccccaagctgctgatctacagcgccagctacagatacaccggcgtgcccgacagattcagcggcagcggcagcggcaccgacttcaccctgaccatcagcagcctgcagcccgaggacttcgccgtgtactactgccagcagcactacatcacccccctgaccttcggcgccggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31358 - RNA, 1326 nt, synthetic construct
  misc_feature 1..1326: note = derived and/or modified sequence opt4 from Samalizumab_HeavyChain1
  source 1..1326: mol_type = other RNA
caggtgcagctgcagcagagcggcagcgagctgaagaagcccggcgccagcgtgaagatcagctgcaaggccagcggctacagcttcaccgactacatcatcctgtgggtgagacagaaccccggcaagggcctggagtggatcggccacatcgacccctactacggcagcagcaactacaacctgaagttcaagggcagagtgaccatcaccgccgaccagagcaccaccaccgcctacatggagctgagcagcctgagaagcgaggacaccgccgtgtactactgcggcagaagcaagagagactacttcgactactggggccagggcaccaccctgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 31359 - RNA, 642 nt, synthetic construct
  misc_feature 1..642: note = derived and/or modified sequence opt4 from Samalizumab_LightChain1
  source 1..642: mol_type = other RNA
gacatccagatgacccagagccccagcagcctgagcgccagcatcggcgacagagtgaccatcacctgcaaggccagccaggacatcaacagctacctgagctggttccagcagaagcccggcaaggcccccaagctgctgatctacagagccaacagactggtggacggcgtgcccagcagattcagcggcagcggcagcggcaccgactacaccctgaccatcagcagcctgcagcccgaggacttcgccgtgtactactgcctgcagtacgacgagttcccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31360 - RNA, 1338 nt, synthetic construct
  misc_feature 1..1338: note = derived and/or modified sequence opt4 from Sarilumab_HeavyChain1
  source 1..1338: mol_type = other RNA
gaggtgcagctggtggagagcggcggcggcctggtgcagcccggcagaagcctgagactgagctgcgccgccagcagattcaccttcgacgactacgccatgcactgggtgagacaggcccccggcaagggcctggagtgggtgagcggcatcagctggaacagcggcagaatcggctacgccgacagcgtgaagggcagattcaccatcagcagagacaacgccgagaacagcctgttcctgcagatgaacggcctgagagccgaggacaccgccctgtactactgcgccaagggcagagacagcttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31361 - RNA, 642 nt, synthetic construct
  misc_feature 1..642: note = derived and/or modified sequence opt4 from Sarilumab_LightChain1
  source 1..642: mol_type = other RNA
gacatccagatgacccagagccccagcagcgtgagcgccagcgtgggcgacagagtgaccatcacctgcagagccagccagggcatcagcagctggctggcctggtaccagcagaagcccggcaaggcccccaagctgctgatctacggcgccagcagcctggagagcggcgtgcccagcagattcagcggcagcggcagcggcaccgacttcaccctgaccatcagcagcctgcagcccgaggacttcgccagctactactgccagcaggccaacagcttcccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31362 - RNA, 1296 nt, synthetic construct
  misc_feature 1..1296: note = derived and/or modified sequence opt4 from Satumomab_pendetide_HeavyChain
  source 1..1296: mol_type = other RNA
caggtgcagctgcagcagagcgacgccgagctggtgaagcccggcgccagcgtgaagatcagctgcaaggccagcggctacaccttcaccgaccacgccatccactgggccaagcagaagcccgagcagggcctggagtggatcggctacatcagccccggcaacgacgacatcaagtacaacgagaagttcaagggcaaggccaccctgaccgccgacaagagcagcagcaccgcctacatgcagctgaacagcctgaccagcgaggacagcgccgtgtacttctgcaagagaagctactacggccactggggccagggcaccaccctgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtgtgccccccctgcaagtgccccgcccccaacctgctgggcggccccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccacagagaggactacaacagcaccctgagagtggtgagcgccctgcccatccagcaccaggactggatgagcggcaaggagttcaagtgcaaggtgaacaacaaggacctgcccgcccccatcgagagaaccatcagcaagcccaagggcagcgtgagagccccccaggtgtacgtgctgcccccccccgaggaggagatgaccaagaagcaggtgaccctgacctgcatggtgaccgacttcatgcccgaggacatctacgtggagtggaccaacaacggcaagaccgagctgaactacaagaacaccgagcccgtgctggacagcgacggcagctacttcatgtacagcaagctgagagtggagaagaagaactgggtggagagaaacagctacagctgcagcgtggtgcacgagggcctgcacaaccaccacaccaccaagagcttcagcaga

SEQ ID NO: 31363 - RNA, 630 nt, synthetic construct
  misc_feature 1..630: note = derived and/or modified sequence opt4 from Satumomab_pendetide_LightChain
  source 1..630: mol_type = other RNA
gacatccagatgacccagagccccgccagcctgagcgtgagcgtgggcgagaccgtgaccatcacctgcagagccagcgagaacatctacagcaacctggcctggtaccagcagaagcagggcaagagcccccagctgctggtgtacgccgccaccaacctggccgacggcgtgcccagcagattcagcggcagcggcagcggcacccagtacagcctgaagatcaacagcctgcagagcgaggacttcggcagctactactgccagcacttctggggcaccccctacaccttcggcggcggcaccagactggagatcaagagagccgacgccgcccccaccgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaac

SEQ ID NO: 31364 - RNA, 1371 nt, synthetic construct
  misc_feature 1..1371: note = derived and/or modified sequence opt4 from Secukinumab_HeavyChain1
  source 1..1371: mol_type = other RNA
gaggtgcagctggtggagagcggcggcggcctggtgcagcccggcggcagcctgagactgagctgcgccgccagcggcttcaccttcagcaactactggatgaactgggtgagacaggcccccggcaagggcctggagtgggtggccgccatcaaccaggacggcagcgagaagtactacgtgggcagcgtgaagggcagattcaccatcagcagagacaacgccaagaacagcctgtacctgcagatgaacagcctgagagtggaggacaccgccgtgtactactgcgtgagagactactacgacatcctgaccgactactacatccactactggtacttcgacctgtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31365 - RNA, 645 nt, synthetic construct
  misc_feature 1..645: note = derived and/or modified sequence opt4 from Secukinumab_LightChain1
  source 1..645: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcccctgcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31366 - RNA, 1335 nt, synthetic construct
  misc_feature 1..1335: note = derived and/or modified sequence opt4 from Seribantumab_HeavyChain1
  source 1..1335: mol_type = other RNA
gaggtgcagctgctggagagcggcggcggcctggtgcagcccggcggcagcctgagactgagctgcgccgccagcggcttcaccttcagccactacgtgatggcctgggtgagacaggcccccggcaagggcctggagtgggtgagcagcatcagcagcagcggcggctggaccctgtacgccgacagcgtgaagggcagattcaccatcagcagagacaacagcaagaacaccctgtacctgcagatgaacagcctgagagccgaggacaccgccgtgtactactgcaccagaggcctgaagatggccaccatcttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31367 - RNA, 651 nt, synthetic construct
  misc_feature 1..651: note = derived and/or modified sequence opt4 from Seribantumab_LightChain1
  source 1..651: mol_type = other RNA
cagagcgccctgacccagcccgccagcgtgagcggcagccccggccagagcatcaccatcagctgcaccggcaccagcagcgacgtgggcagctacaacgtggtgagctggtaccagcagcaccccggcaaggcccccaagctgatcatctacgaggtgagccagagacccagcggcgtgagcaacagattcagcggcagcaagagcggcaacaccgccagcctgaccatcagcggcctgcagaccgaggacgaggccgactactactgctgcagctacgccggcagcagcatcttcgtgatcttcggcggcggcaccaaggtgaccgtgctgggccagcccaaggccgcccccagcgtgaccctgttcccccccagcagcgaggagctgcaggccaacaaggccaccctggtgtgcctggtgagcgacttctaccccggcgccgtgaccgtggcctggaaggccgacggcagccccgtgaaggtgggcgtggagaccaccaagcccagcaagcagagcaacaacaagtacgccgccagcagctacctgagcctgacccccgagcagtggaagagccacagaagctacagctgcagagtgacccacgagggcagcaccgtggagaagaccgtggcccccgccgagtgcagc

SEQ ID NO: 31368 - RNA, 1353 nt, synthetic construct
  misc_feature 1..1353: note = derived and/or modified sequence opt4 from Setoxaximab_HeavyChain1
  source 1..1353: mol_type = other RNA
gaggtgcagctgcagcagcccggccccgagctggagaagcccggcgccagcgtgaagctgagctgcaaggccagcggctacagcttcaccgactacaacatgaactgggtgaagcagaacaacggcgagagcctggagtggatcggcaagatcgacccctactacggcggccccagctacaaccagaagttcaaggacaaggccaccctgaccgtggacaagagcagcagcaccgcctacatgcagctgaagagcctgaccagcgaggacagcgccgtgtactactgcaccagaggcggcaacagagactggtacttcgacgtgtggggcgccggcaccaccctgaccgtgagcgccgagttcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31369 - RNA, 660 nt, synthetic construct
  misc_feature 1..660: note = derived and/or modified sequence opt4 from Setoxaximab_LightChain1
  source 1..660: mol_type = other RNA
gacatcgtgctgagccagagccccagcagcctggtggtgagcgtgggcgagaaggtgaccatgagctgcaagagcagccagagcctgctgtacagcagaaaccagaagaactacctggcctggtaccagcagaagcccggccagagccccaaggtgctgatctactgggccagcaccagagagagcggcgtgcccgacagactgaccggcagcggcagcggcaccgacttcaccctgaccatcagcagcgtgaaggccgaggacctggccgtgtactactgccagcagtactacagctaccccctgaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31370 - RNA, 1338 nt, synthetic construct
  misc_feature 1..1338: note = derived and/or modified sequence opt4 from Sifalimumab_HeavyChain1
  source 1..1338: mol_type = other RNA
caggtgcagctggtgcagagcggcgccgaggtgaagaagcccggcgccagcgtgaaggtgagctgcaaggccagcggctacaccttcaccagctacagcatcagctgggtgagacaggcccccggccagggcctggagtggatgggctggatcagcgtgtacaacggcaacaccaactacgcccagaagttccagggcagagtgaccatgaccaccgacaccagcaccagcaccgcctacctggagctgagaagcctgagaagcgacgacaccgccgtgtactactgcgccagagaccccatcgccgccggctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31371 - RNA, 645 nt, synthetic construct
  misc_feature 1..645: note = derived and/or modified sequence opt4 from Sifalimumab_LightChain1
  source 1..645: mol_type = other RNA
gagatcgtgctgacccagagccccggcaccctgagcctgagccccggcgagagagccaccctgagctgcagagccagccagagcgtgagcagcacctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31372 - RNA, 1347 nt, synthetic construct
  misc_feature 1..1347: note = derived and/or modified sequence opt4 from Siltuximab_HeavyChain1
  source 1..1347: mol_type = other RNA
gaggtgcagctggtggagagcggcggcaagctgctgaagcccggcggcagcctgaagctgagctgcgccgccagcggcttcaccttcagcagcttcgccatgagctggttcagacagagccccgagaagagactggagtgggtggccgagatcagcagcggcggcagctacacctactaccccgacaccgtgaccggcagattcaccatcagcagagacaacgccaagaacaccctgtacctggagatgagcagcctgagaagcgaggacaccgccatgtactactgcgccagaggcctgtggggctactacgccctggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31373 - RNA, 639 nt, synthetic construct
  misc_feature 1..639: note = derived and/or modified sequence opt4 from Siltuximab_LightChain1
  source 1..639: mol_type = other RNA
cagatcgtgctgatccagagccccgccatcatgagcgccagccccggcgagaaggtgaccatgacctgcagcgccagcagcagcgtgagctacatgtactggtaccagcagaagcccggcagcagccccagactgctgatctacgacaccagcaacctggccagcggcgtgcccgtgagattcagcggcagcggcagcggcaccagctacagcctgaccatcagcagaatggaggccgaggacgccgccacctactactgccagcagtggagcggctacccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31374 - RNA, 1329 nt, synthetic construct
  misc_feature 1..1329: note = derived and/or modified sequence opt4 from Simtuzumab_HeavyChain1
  source 1..1329: mol_type = other RNA
caggtgcagctggtgcagagcggcgccgaggtgaagaagcccggcgccagcgtgaaggtgagctgcaaggccagcggctacgccttcacctactacctgatcgagtgggtgagacaggcccccggccagggcctggagtggatcggcgtgatcaaccccggcagcggcggcaccaactacaacgagaagttcaagggcagagccaccatcaccgccgacaagagcaccagcaccgcctacatggagctgagcagcctgagaagcgaggacaccgccgtgtacttctgcgccagaaactggatgaacttcgactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31375 - RNA, 657 nt, synthetic construct
  misc_feature 1..657: note = derived and/or modified sequence opt4 from Simtuzumab_LightChain1
  source 1..657: mol_type = other RNA
gacatcgtgatgacccagacccccctgagcctgagcgtgacccccggccagcccgccagcatcagctgcagaagcagcaagagcctgctgcacagcaacggcaacacctacctgtactggttcctgcagaagcccggccagagcccccagttcctgatctacagaatgagcaacctggccagcggcgtgcccgacagattcagcggcagcggcagcggcaccgacttcaccctgaagatcagcagagtggaggccgaggacgtgggcgtgtactactgcatgcagcacctggagtacccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31376 - RNA, 1347 nt, synthetic construct
  misc_feature 1..1347: note = derived and/or modified sequence opt4 from Sirukumab_HeavyChain1
  source 1..1347: mol_type = other RNA
gaggtgcagctggtggagagcggcggcggcctggtgcagcccggcggcagcctgagactgagctgcgccgccagcggcttcaccttcagccccttcgccatgagctgggtgagacaggcccccggcaagggcctggagtgggtggccaagatcagccccggcggcagctggacctactacagcgacaccgtgaccggcagattcaccatcagcagagacaacgccaagaacagcctgtacctgcagatgaacagcctgagagccgaggacaccgccgtgtactactgcgccagacagctgtggggctactacgccctggacatctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31377 - RNA, 639 nt, synthetic construct
  misc_feature 1..639: note = derived and/or modified sequence opt4 from Sirukumab_LightChain1
  source 1..639: mol_type = other RNA
gagatcgtgctgacccagagccccgccaccctgagcctgagccccggcgagagagccaccctgagctgcagcgccagcatcagcgtgagctacatgtactggtaccagcagaagcccggccaggcccccagactgctgatctacgacatgagcaacctggccagcggcatccccgccagattcagcggcagcggcagcggcaccgacttcaccctgaccatcagcagcctggagcccgaggacttcgccgtgtactactgcatgcagtggagcggctacccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31378 - RNA, 1338 nt, synthetic construct
  misc_feature 1..1338: note = derived and/or modified sequence opt4 from Sofituzumab_vedotin_HeavyChain1
  source 1..1338: mol_type = other RNA
gaggtgcagctggtggagagcggcggcggcctggtgcagcccggcggcagcctgagactgagctgcgccgccagcggctacagcatcaccaacgactacgcctggaactgggtgagacaggcccccggcaagggcctggagtgggtgggctacatcagctacagcggctacaccacctacaaccccagcctgaagagcagattcaccatcagcagagacaccagcaagaacaccctgtacctgcagatgaacagcctgagagccgaggacaccgccgtgtactactgcgccagatggaccagcggcctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31379 - RNA, 642 nt, synthetic construct
  misc_feature 1..642: note = derived and/or modified sequence opt4 from Sofituzumab_vedotin_LightChain1
  source 1..642: mol_type = other RNA
gacatccagatgacccagagccccagcagcctgagcgccagcgtgggcgacagagtgaccatcacctgcaaggccagcgacctgatccacaactggctggcctggtaccagcagaagcccggcaaggcccccaagctgctgatctacggcgccaccagcctggagaccggcgtgcccagcagattcagcggcagcggcagcggcaccgacttcaccctgaccatcagcagcctgcagcccgaggacttcgccacctactactgccagcagtactggaccacccccttcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31380 - RNA, 1323 nt, synthetic construct
  misc_feature 1..1323: note = derived and/or modified sequence opt4 from Solanezumab_HeavyChain1
  source 1..1323: mol_type = other RNA
gaggtgcagctggtggagagcggcggcggcctggtgcagcccggcggcagcctgagactgagctgcgccgccagcggcttcaccttcagcagatacagcatgagctgggtgagacaggcccccggcaagggcctggagctggtggcccagatcaacagcgtgggcaacagcacctactaccccgacaccgtgaagggcagattcaccatcagcagagacaacgccaagaacaccctgtacctgcagatgaacagcctgagagccgaggacaccgccgtgtactactgcgccagcggcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31381 - RNA, 1326 nt, synthetic construct
  misc_feature 1..1326: note = derived and/or modified sequence opt4 from Solanezumab_HeavyChain
  source 1..1326: mol_type = other RNA
gaggtgcagctggtggagagcggcggcggcctggtgcagcccggcggcagcctgagactgagctgcgccgccagcggcttcaccttcagcagatacagcatgagctgggtgagacaggcccccggcaagggcctggagctggtggcccagatcaacagcgtgggcaacagcacctactaccccgacaccgtgaagggcagattcaccatcagcagagacaacgccaagaacaccctgtacctgcagatgaacagcctgagagccgaggacaccgccgtgtactactgcgccagcggcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31382 - RNA, 657 nt, synthetic construct
  misc_feature 1..657: note = derived and/or modified sequence opt4 from Solanezumab_LightChain1
  source 1..657: mol_type = other RNA
gacgtggtgatgacccagagccccctgagcctgcccgtgaccctgggccagcccgccagcatcagctgcagaagcagccagagcctgatctacagcgacggcaacgcctacctgcactggttcctgcagaagcccggccagagccccagactgctgatctacaaggtgagcaacagattcagcggcgtgcccgacagattcagcggcagcggcagcggcaccgacttcaccctgaagatcagcagagtggaggccgaggacgtgggcgtgtactactgcagccagagcacccacgtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31383 - RNA, 1506 nt, synthetic construct
  misc_feature 1..1506: note = derived and/or modified sequence opt4 from Solitomab_HeavyChain1
  source 1..1506: mol_type = other RNA
gagctggtgatgacccagagccccagcagcctgaccgtgaccgccggcgagaaggtgaccatgagctgcaagagcagccagagcctgctgaacagcggcaaccagaagaactacctgacctggtaccagcagaagcccggccagccccccaagctgctgatctactgggccagcaccagagagagcggcgtgcccgacagattcaccggcagcggcagcggcaccgacttcaccctgaccatcagcagcgtgcaggccgaggacctggccgtgtactactgccagaacgactacagctaccccctgaccttcggcgccggcaccaagctggagatcaagggcggcggcggcagcggcggcggcggcagcggcggcggcggcagcgaggtgcagctgctggagcagagcggcgccgagctggtgagacccggcaccagcgtgaagatcagctgcaaggccagcggctacgccttcaccaactactggctgggctgggtgaagcagagacccggccacggcctggagtggatcggcgacatcttccccggcagcggcaacatccactacaacgagaagttcaagggcaaggccaccctgaccgccgacaagagcagcagcaccgcctacatgcagctgagcagcctgaccttcgaggacagcgccgtgtacttctgcgccagactgagaaactgggacgagcccatggactactggggccagggcaccaccgtgaccgtgagcagcggcggcggcggcagcgacgtgcagctggtgcagagcggcgccgaggtgaagaagcccggcgccagcgtgaaggtgagctgcaaggccagcggctacaccttcaccagatacaccatgcactgggtgagacaggcccccggccagggcctggagtggatcggctacatcaaccccagcagaggctacaccaactacgccgacagcgtgaagggcagattcaccatcaccaccgacaagagcaccagcaccgcctacatggagctgagcagcctgagaagcgaggacaccgccacctactactgcgccagatactacgacgaccactactgcctggactactggggccagggcaccaccgtgaccgtgagcagcggcgagggcaccagcaccggcagcggcggcagcggcggcagcggcggcgccgacgacatcgtgctgacccagagccccgccaccctgagcctgagccccggcgagagagccaccctgagctgcagagccagccagagcgtgagctacatgaactggtaccagcagaagcccggcaaggcccccaagagatggatctacgacaccagcaaggtggccagcggcgtgcccgccagattcagcggcagcggcagcggcaccgactacagcctgaccatcaacagcctggaggccgaggacgccgccacctactactgccagcagtggagcagcaaccccctgaccttcggcggcggcaccaaggtggagatcaagcaccaccaccaccaccac

SEQ ID NO: 31384 - RNA, 1506 nt, synthetic construct; identical to SEQ ID NO: 31383
  misc_feature 1..1506: note = derived and/or modified sequence opt4 from Solitomab_SingleChain
  source 1..1506: mol_type = other RNA

SEQ ID NO: 31385 - RNA, 702 nt, synthetic construct
  misc_feature 1..702: note = derived and/or modified sequence opt4 from Sonepcizumab_LightChain_Precursor
  source 1..702: mol_type = other RNA
atgagcgtgcccacccaggtgctgggcctgctgctgctgtggctgaccgacgccagatgcgagaccaccgtgacccagagccccagcttcctgagcgccagcgtgggcgacagagtgaccatcacctgcatcaccaccaccgacatcgacgacgacatgaactggttccagcaggagcccggcaaggcccccaagctgctgatcagcgagggcaacatcctgagacccggcgtgcccagcagattcagcagcagcggctacggcaccgacttcaccctgaccatcagcaagctgcagcccgaggacttcgccacctactactgcctgcagagcgacaacctgcccttcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31386 - RNA, 1365 nt, synthetic construct
  misc_feature 1..1365: note = derived and/or modified sequence opt4 from Sonepcizumab_gamma1-Chain_Precursor
  source 1..1365: mol_type = other RNA
atggagtggagctgggtgttcctgttcttcctgagcgtgaccaccggcgtgcacagcgaggtgcagctggtgcagagcggcgccgaggtgaagaagcccggcgagagcctgaagatcagctgccagagcttcggctacatcttcatcgaccacaccatccactggatgagacagatgcccggccagggcctggagtggatgggcgccatcagccccagacacgacatcaccaagtacaacgagatgttcagaggccaggtgaccatcagcgccgacaagagcagcagcaccgcctacctgcagtggagcagcctgaaggccagcgacaccgccatgtacttctgcgccagaggcggcttctacggcagcaccatctggttcgacttctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31387 - RNA, 1338 nt, synthetic construct
  misc_feature 1..1338: note = derived and/or modified sequence opt4 from Stamulumab_HeavyChain1
  source 1..1338: mol_type = other RNA
gtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatgggcatcatcaaccccagcggcggcagcaccagctacgcccagaagttccagggcagagtgaccatgaccagagacaccagcaccagcaccgtgtacatggagctgagcagcctgagaagcgaggacaccgccgtgtactactgcgccagagacgagaactggggcttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31388 - RNA, 633 nt, synthetic construct
  misc_feature 1..633: note = derived and/or modified sequence opt4 from Stamulumab_LightChain1
  source 1..633: mol_type = other RNA
agctacgagctgacccagccccccagcgtgagcgtgagccccggccagaccgccagcatcacctgcagcggccacgccctgggcgacaagttcgtgagctggtaccagcagaagcccggccagagccccgtgctggtgatctacgacgacacccagagacccagcggcatccccgagagattcagcggcagcaacagcggcaacaccgccaccctgaccatcagcggcacccaggccatggacgaggccgactactactgccaggcctgggacagcagcttcgtgttcggcggcggcaccaaggtgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31389 - RNA, 1356 nt, synthetic construct
  misc_feature 1..1356: note = derived and/or modified sequence opt4 from Suptavumab_HeavyChain1
  source 1..1356: mol_type = other RNA
gaggtgcagctggtggagagcggcggcgacctggtgcagcccggcagaagcctgagactgagctgcgtggccagcggcttcaccttcgacgactacgccatgcactgggtgagacaggcccccggcaagggcctggagtgggtgagcggcgtgagctggagcggcagcaccgtgggctacgccgacagcgtgaagggcagattcaccgtgagcagagacaacgcccagaagagcctgtacctgcagatgaacagcctgagagccgaggacaccgccctgtactactgcgtgaaggacgcctacaagttcaactactactactacggcctggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31390 - RNA, 642 nt, synthetic construct
  misc_feature 1..642: note = derived and/or modified sequence opt4 from Suptavumab_LightChain1
  source 1..642: mol_type = other RNA
gagatcgtgatgacccagagccccgccaccctgagcgtgagccccggcgagagagccaccctgagctgcagagccagccagaccatcctgagcaacctggcctggtacctgcagaagcccggccaggcccccagactgctgatctacggcgccagcaccagagccaccggcctgcccgccagattcagcggcagcggcagcggcaccgagttcaccctgaccatcagcagcctgcagagcgaggacttcgccgtgtactactgccagcagtacaacaactggcccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31391 - RNA, 1344 nt, synthetic construct
  misc_feature 1..1344: note = derived and/or modified sequence opt4 from Suvizumab_HeavyChain1
  source 1..1344: mol_type = other RNA
caggtgcagctggtgcagagcggcgccgaggtgaagaagcccggcgccagcgtgaaggtgagctgcaaggccagcggctacaccttcaccaacagctggatcggctggttcagacaggcccccggccagggcctggagtggatcggcgacatctaccccggcggcggctacaccaactacaacgagatcttcaagggcaaggccaccatgaccgccgacaccagcaccaacaccgcctacatggagctgagcagcctgagaagcgaggacaccgccgtgtactactgcagcagaggcatccccggctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31392 - RNA, 660 nt, synthetic construct
  misc_feature 1..660: note = derived and/or modified sequence opt4 from Suvizumab_LightChain1
  source 1..660: mol_type = other RNA
gacatccagatgacccagagacccgacagcctgagcgccagcgtgggcgacagagtgaccatgagctgcaagagcagccagagcctgctgaacagcggcgaccagaagaactacctgacctggtaccagcagaagcccggccagccccccaagctgctgatctactgggccagcaccggcgagagcggcgtgcccgacagattcagcggcagcggcagcggcaccgacttcaccttcaccatcagcagcctgcagcccgaggacatcgccacctactactgccagaacgactacagctacccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31393 - RNA, 1350 nt, synthetic construct
  misc_feature 1..1350: note = derived and/or modified sequence opt4 from Tabalumab_HeavyChain1
  source 1..1350: mol_type = other RNA
caggtgcagctgcagcagtggggcgccggcctgctgaagcccagcgagaccctgagcctgacctgcgccgtgtacggcggcagcttcagcggctactactggagctggatcagacagccccccggcaagggcctggagtggatcggcgagatcaaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagaggctactacgacatcctgaccggctactactactacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31394 - RNA, 642 nt, synthetic construct
  misc_feature 1..642: note = derived and/or modified sequence opt4 from Tabalumab_LightChain1
  source 1..642: mol_type = other RNA
gagatcgtgctgacccagagccccgccaccctgagcctgagccccggcgagagagccaccctgagctgcagagccagccagagcgtgagcagatacctggcctggtaccagcagaagcccggccaggcccccagactgctgatctacgacgccagcaacagagccaccggcatccccgccagattcagcggcagcggcagcggcaccgacagcaccctgaccatcagcagcctggagcccgaggacttcgccgtgtactactgccagcagagaagcaactggcccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcaacaccctgaccctgagcaaggccgactacgagaagcacaaggtgtacgcctgcgaggtgacccaccagggcctgagcagccccgtgaccaagagcttcaacagaggcgagtgc

SEQ ID NO: 31395 - RNA, 1332 nt, synthetic construct
  misc_feature 1..1332: note = derived and/or modified sequence opt4 from Tacatuzuab_HeavyChain1
  source 1..1332: mol_type = other RNA
caggtgcagctgcagcagagcggcgccgaggtgaagaagcccggcagcagcgtgaaggtgagctgcaaggccagcggctacgccttcaccagctacgtgatccactgggtgagacaggcccccggccagggcctgtactggatcggctacatccacccctacaacggcggcaccaagtacaacgagaagttcaagggcaaggccaccatcaccgccgacgagagcaccaacaccgcctacgagctgagcagcctgagaagcgaggacaccgccttctacttctgcgccagaagcggcggcggcgaccccttcgcctactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 31396 - RNA, 636 nt, synthetic construct
  misc_feature 1..636: note = derived and/or modified sequence opt4 from Tacatuzuab_LightChain1
  source 1..636: mol_type = other RNA
gacatccagctgacccagagccccagcagcctgagcgccagcgtgggcgacagagtgaccatcacctgcaaggccagccaggacatcaacaagtacatcggctggtaccagcagaagcccggcaaggcccccaagctgctgcactacaccagcgccctgctgcccggcatccccagcagattcagcggcagcggcagcggcagagactacaccttcaccatcagcagcctgcagcccgaggacatcgccacctactactgcctgcagtacgacgacctgtggaccttcggcggcggcaccaagctgcagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31397 - RNA, 678 nt, synthetic construct
  misc_feature 1..678: note = derived and/or modified sequence opt4 from Tadocizumab_fab_fragment_HeavyChain
  source 1..678: mol_type = other RNA
caggtgcagctggtgcagagcggcgccgaggtgaagaagcccggcagcagcgtgaaggtgagctgcaaggccagcggctacgccttcaccaactacctgatcgagtgggtgagacaggcccccggccagggcctggagtggatcggcgtgatctaccccggcagcggcggcaccaactacaacgagaagttcaagggcagagtgaccctgaccgtggacgagagcaccaacaccgcctacatggagctgagcagcctgagaagcgaggacaccgccgtgtacttctgcgccagaagagacggcaactacggctggttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccac

SEQ ID NO: 31398 - RNA, 582 nt, synthetic construct
  misc_feature 1..582: note = derived and/or modified sequence opt4 from Tadocizumab_fab_fragment_LightChain
  source 1..582: mol_type = other RNA
gacatccagatgacccagacccccagcaccctgagcgccagcgtgggcgacagagtgaccatcagctgcagagccagccaggacatcaacaactacctgaactggtaccagcagaagcccggcaaggcccccaagctgctgatctactacaccagcaccctgcacagcggcgtgcccagcagattcagcggcagcggcagcggcaccgactacaccctgaccatcagcagcctgcagcccgacgacttcgccacctacttctgccagcagggcaacaccctgccctggaccttcggccagggcaccaaggtggaggtgaagagaaccgtggccgcccccagcgtgttcatcttcccccccagcgacgagcagctgaagagcggcaccgccagcgtggtgtgcctgctgaacaacttctacgagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31399 - RNA, 1359 nt, synthetic construct
  misc_feature 1..1359: note = derived and/or modified sequence opt4 from Talizumab_HeavyChain1
  source 1..1359: mol_type = other RNA
caggtgcagctggtgcagagcggcgccgaggtgaagaagcccggcgccagcgtgaaggtgagctgcaaggccagcggctacaccttcagcatgtactggctggagtgggtgagacaggcccccggccacggcctggagtgggtgggcgagatcagccccggcaccttcaccaccaactacaacgagaagttcaaggccagagccaccttcaccgccgacaccagcaccaacaccgcctacatggagctgagcagcctgagaagcgaggacaccgccgtgtactactgcgccagattcagccacttcagcggcagcaactacgactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31400 - RNA, 642 nt, synthetic construct
  misc_feature 1..642: note = derived and/or modified sequence opt4 from Talizumab_LightChain1
  source 1..642: mol_type = other RNA
gacatcctgctgacccagagccccggcaccctgagcctgagccccggcgagagagccaccctgagctgcagagccagccagagcatcggcaccaacatccactggtaccagcagaagcccggccaggcccccagactgctgatcaagtacgccagcgagagcatcagcggcatccccagcagattcagcggcagcggcagcggcaccgacttcaccctgaccatcagcagactggagcccgaggacttcgccatgtactactgccagcagagcgacagctggcccaccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31401 - RNA, 1368 nt, synthetic construct
  misc_feature 1..1368: note = derived and/or modified sequence opt4 from Tamtuvetmab_HeavyChain1
  source 1..1368: mol_type = other RNA
gaggtgaagctgctggagagcggcggcggcctggtgcagcccggcggcagcatgagactgagctgcgccggcagcggcttcaccttcaccgacttctacatgaactggatcagacagcccgccggcaaggcccccgagtggctgggcttcatcagagacaaggccaagggctacaccaccgagtacaaccccagcgtgaagggcagattcaccatcagcagagacaacacccagaacatgctgtacctgcagatgaacaccctgagagccgaggacaccgccacctactactgcgccagagagggccacaccgccgcccccttcgactactggggccagggcaccctggtgaccgtgagcagcgccagcaccaccgcccccagcgtgttccccctggcccccagctgcggcagcaccagcggcagcaccgtggccctggcctgcctggtgagcggctacttccccgagcccgtgaccgtgagctggaacagcggcagcctgaccagcggcgtgcacaccttccccagcgtgctgcagagcagcggcctgtacagcctgagcagcatggtgaccgtgcccagcagcagatggcccagcgagaccttcacctgcaacgtggcccaccccgccagcaagaccaaggtggacaagcccgtgcccaagagagagaacggcagagtgcccagaccccccgactgccccaagtgccccgcccccgagatgctgggcggccccagcgtgttcatcttcccccccaagcccaaggacaccctgctgatcgccagaacccccgaggtgacctgcgtggtggtggacctggaccccgaggaccccgaggtgcagatcagctggttcgtggacggcaagcagatgcagaccgccaagacccagcccagagaggagcagttcaacggcacctacagagtggtgagcgtgctgcccatcggccaccaggactggctgaagggcaagcagttcacctgcaaggtgaacaacaaggccctgcccagccccatcgagagaaccatcagcaaggccagaggccaggcccaccagcccagcgtgtacgtgctgccccccagcagagaggagctgagcaagaacaccgtgagcctgacctgcctgatcaaggacttcttcccccccgacatcgacgtggagtggcagagcaacggccagcaggagcccgagagcaagtacagaaccacccccccccagctggacgaggacggcagctacttcctgtacagcaagctgagcgtggacaagagcagatggcagagaggcgacaccttcatctgcgccgtgatgcacgaggccctgcacaaccactacacccagaagagcctgagccacagccccggcaag

SEQ ID NO: 31402 - RNA, 639 nt, synthetic construct
  misc_feature 1..639: note = derived and/or modified sequence opt4 from Tamtuvetmab_LightChain1
  source 1..639: mol_type = other RNA
gacatcaagatgacccagagccccagcttcctgagcgccagcgtgggcgacagagtgaccctgaactgcaaggccagccagaacatcgacaagtacctgaactggtaccagcagaagctgggcgagagccccaagctgctgatctacaacaccaacaacctgcagaccggcatccccagcagattcagcggcagcggcagcggcaccgacttcaccctgaccatcagcagcctgcagcccgaggacgtggccacctacttctgcctgcagcacatcagcagacccagaaccttcggcggcggcacccacctgaccgtgctgggccagcccaaggccagccccagcgtgaccctgttcccccccagcagcgaggagctgggcgccaacaaggccaccctggtgtgcctgatcagcgacttctaccccagcggcgtgaccgtggcctggaaggccgacggcagccccatcacccagggcgtggagaccaccaagcccagcaagcagagcaacaacaagtacgccgccagcagctacctgagcctgacccccgacaagtggaagagccacagcagcttcagctgcctggtgacccacgagggcagcaccgtggagaagaaggtggcccccgccgagtgcagc

SEQ ID NO: 31403 - RNA, 360 nt, synthetic construct
  misc_feature 1..360: note = derived and/or modified sequence opt4 from Tanezumab_HeavyChain
  source 1..360: mol_type = other RNA
caggtgcagctgcaggagagcggccccggcctggtgaagcccagcgagaccctgagcctgacctgcaccgtgagcggcttcagcctgatcggctacgacctgaactggatcagacagccccccggcaagggcctggagtggatcggcatcatctggggcgacggcaccaccgactacaacagcgccgtgaagagcagagtgaccatcagcaaggacaccagcaagaaccagttcagcctgaagctgagcagcgtgaccgccgccgacaccgccgtgtactactgcgccagaggcggctactggtacgccaccagctactacttcgactactggggccagggcaccctggtgaccgtgagc

SEQ ID NO: 31404 - RNA, 327 nt, synthetic construct
  misc_feature 1..327: note = derived and/or modified sequence opt4 from Tanezumab_LightChain
  source 1..327: mol_type = other RNA
gacatccagatgacccagagccccagcagcctgagcgccagcgtgggcgacagagtgaccatcacctgcagagccagccagagcatcagcaacaacctgaactggtaccagcagaagcccggcaaggcccccaagctgctgatctactacaccagcagattccacagcggcgtgcccagcagattcagcggcagcggcagcggcaccgacttcaccttcaccatcagcagcctgcagcccgaggacatcgccacctactactgccagcaggagcacaccctgccctacaccttcggccagggcaccaagctggagatcaagagaacc

SEQ ID NO: 31405 - RNA, 1323 nt, synthetic construct
  misc_feature 1..1323: note = derived and/or modified sequence opt4 from Tarextumab_HeavyChain1
  source 1..1323: mol_type = other RNA
gaggtgcagctggtggagagcggcggcggcctggtgcagcccggcggcagcctgagactgagctgcgccgccagcggcttcaccttcagcagcagcggcatgagctgggtgagacaggcccccggcaagggcctggagtgggtgagcgtgatcgccagcagcggcagcaacacctactacgccgacagcgtgaagggcagattcaccatcagcagagacaacagcaagaacaccctgtacctgcagatgaacagcctgagagccgaggacaccgccgtgtactactgcgccagaagcatcttctacaccacctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31406 - RNA, 645 nt, synthetic construct
  misc_feature 1..645: note = derived and/or modified sequence opt4 from Tarextumab_LightChain1
  source 1..645: mol_type = other RNA
gacatcgtgctgacccagagccccgccaccctgagcctgagccccggcgagagagccaccctgagctgcagagccagccagagcgtgagaagcaactacctggcctggtaccagcagaagcccggccaggcccccagactgctgatctacggcgccagcagcagagccaccggcgtgcccgccagattcagcggcagcggcagcggcaccgacttcaccctgaccatcagcagcctggagcccgaggacttcgccgtgtactactgccagcagtacagcaacttccccatcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31407 - RNA, 363 nt, synthetic construct
  misc_feature 1..363: note = derived and/or modified sequence opt4 from Tefibazumab_HeavyChain1
  source 1..363: mol_type = other RNA
caggtgcagctgaaggagagcggccccggcctggtgaagcccagccagaccctgagcatcacctgcaccatcagcggcttcagcctgagcagatacagcgtgcactgggtgagacagccccccggcaagggcctggagtggctgggcatgatctggggcggcggcaacaccgactacaacagcgccctgaagagcagactgagcatcagcaaggacaacagcaagaaccaggtgttcctgaagatgaacagcctgaccgccgccgacaccgccgtgtactactgcgccagaaagggcgagttctactacggctacgacggcttcgtgtactggggccagggcaccctggtgaccgtgagcagc

SEQ ID NO: 31408 - RNA, 336 nt, synthetic construct
  misc_feature 1..336: note = derived and/or modified sequence opt4 from Tefibazumab_LightChain1
  source 1..336: mol_type = other RNA
gacatcgtgatgacccagagccccgacagcctggccgtgagcctgggcgagagagtgaccatgaactgcaagagcagccagagcgtgctgtacagcagcaaccagaagaactacctggcctggtaccagcagaagcccggccagagccccaagctgctgatctactgggccagcaccagagagagcggcgtgcccgacagattcagcggcagcggcagcggcaccgacttcaccctgaccatcagcagcgtgcaggccgaggacctggccgtgtactactgccaccagtacctgagcagctacaccttcggcggcggcaccaagctggagatcaag

SEQ ID NO: 31409 - RNA, 1368 nt, synthetic construct
  misc_feature 1..1368: note = derived and/or modified sequence opt4 from Tenatumomab_HeavyChain1
  source 1..1368: mol_type = other RNA
gagatccagctgcagcagagcggccccgagctggtgaagcccggcgccagcgtgaaggtgagctgcaaggccagcggctacgccttcaccagctacaacatgtactgggtgaagcagagccacggcaagagcctggagtggatcggctacatcgacccctacaacggcgtgaccagctacaaccagaagttcaagggcaaggccaccctgaccgtggacaagagcagcagcaccgcctacatgcacctgaacagcctgaccagcgaggacagcgccgtgtactactgcgccagaggcggcggcagcatctactacgccatggactactggggccagggcaccagcgtgaccgtgagcagcgccaagaccaccccccccagcgtgtaccccctggcccccggctgcggcgacaccaccggcagcagcgtgaccctgggctgcctggtgaagggctacttccccgagagcgtgaccgtgacctggaacagcggcagcctgagcagcagcgtgcacaccttccccgccctgctgcagagcggcctgtacaccatgagcagcagcgtgaccgtgcccagcagcacctggcccagccagaccgtgacctgcagcgtggcccaccccgccagcagcaccaccgtggacaagaagctggagcccagcggccccatcagcaccatcaacccctgccccccctgcaaggagtgccacaagtgccccgcccccaacctggagggcggccccagcgtgttcatcttcccccccaacatcaaggacgtgctgatgatcagcctgacccccaaggtgacctgcgtggtggtggacgtgagcgaggacgaccccgacgtgcagatcagctggttcgtgaacaacgtggaggtgcacaccgcccagacccagacccacagagaggactacaacagcaccatcagagtggtgagcaccctgcccatccagcaccaggactggatgagcggcaaggagttcaagtgcaaggtgaacaacaaggacctgcccagccccatcgagagaaccatcagcaagatcaagggcctggtgagagccccccaggtgtacatcctgcccccccccgccgagcagctgagcagaaaggacgtgagcctgacctgcctggtggtgggcttcaaccccggcgacatcagcgtggagtggaccagcaacggccacaccgaggagaactacaaggacaccgcccccgtgctggacagcgacggcagctacttcatctacagcaagctgaacatgaagaccagcaagtgggagaagaccgacagcttcagctgcaacgtgagacacgagggcctgaagaactactacctgaagaagaccatcagcagaagccccggcaag

SEQ ID NO: 31410 - RNA, 657 nt, synthetic construct
  misc_feature 1..657: note = derived and/or modified sequence opt4 from Tenatumomab_LightChain1
  source 1..657: mol_type = other RNA
gacatcgtgatgacccaggccgcccccagcgtgcccgtgacccccggcgagagcgtgagcatcagctgcagaagcagcaagagcctgctgcacagcaacggcaacacctacctgtactggttcctgcagagacccggccagagcccccagctgctgatctacagaatgagcaacctggccagcggcgtgcccgacagattcagcggcagcggcagcggcaccgccttcaccctgagaatcagcagagtggaggccgaggacgtgggcgtgtactactgcatgcagcacctggagtaccccctgaccttcggcgccggcaccaagctggagctgaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 31411 - RNA, 1356 nt, synthetic construct
  misc_feature 1..1356: note = derived and/or modified sequence opt4 from Teneliximab_HeavyChain1
  source 1..1356: mol_type = other RNA
cagatccagctggtgcagagcggccccgagctgaagaagcccggcgagaccgtgagaatcagctgcaaggccagcggctacgccttcaccaccaccggcatgcagtgggtgcaggagatgcccggcaagggcctgaagtggatcggctggatcaacacccacagcggcgtgcccaagtacgtggaggacttcaagggcagattcgccttcagcctggagaccagcgccaacaccgcctacctgcagatcagcaacctgaagaacgaggacaccgccacctacttctgcgtgagaagcggcaacggcaactacgacctggcctacttcgcctactggggccagggcaccctggtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31412 - RNA, 642 nt, synthetic construct
  misc_feature 1..642: note = derived and/or modified sequence opt4 from Teneliximab_LightChain1
  source 1..642: mol_type = other RNA
gacatcgtgctgacccagagccccgccaccctgagcgtgacccccggcgacagagtgagcctgagctgcagagccagccagagcatcagcgactacctgcactggtaccagcagaagagccacgagagccccagactgctgatcaagtacgccagccacagcatcagcggcatccccagcagattcagcggcagcggcagcggcagcgacttcaccctgagcatcaacagcgtggagcccgaggacgtgggcatctactactgccagcacggccacagcttcccctggaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31413 - RNA, 1347 nt, synthetic construct
  misc_feature 1..1347: note = derived and/or modified sequence opt4 from Teplizumab_HeavyChain1
  source 1..1347: mol_type = other RNA
caggtgcagctggtgcagagcggcggcggcgtggtgcagcccggcagaagcctgagactgagctgcaaggccagcggctacaccttcaccagatacaccatgcactgggtgagacaggcccccggcaagggcctggagtggatcggctacatcaaccccagcagaggctacaccaactacaaccagaaggtgaaggacagattcaccatcagcagagacaacagcaagaacaccgccttcctgcagatggacagcctgagacccgaggacaccggcgtgtacttctgcgccagatactacgacgaccactactgcctggactactggggccagggcacccccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31414 - RNA, 639 nt, synthetic construct
  misc_feature 1..639: note = derived and/or modified sequence opt4 from Teplizumab_LightChain1
  source 1..639: mol_type = other RNA
gacatccagatgacccagagccccagcagcctgagcgccagcgtgggcgacagagtgaccatcacctgcagcgccagcagcagcgtgagctacatgaactggtaccagcagacccccggcaaggcccccaagagatggatctacgacaccagcaagctggccagcggcgtgcccagcagattcagcggcagcggcagcggcaccgactacaccttcaccatcagcagcctgcagcccgaggacatcgccacctactactgccagcagtggagcagcaaccccttcaccttcggccagggcaccaagctgcagatcaccagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31415 - RNA, 1344 nt, synthetic construct
  misc_feature 1..1344: note = derived and/or modified sequence opt4 from Teprotumumab_HeavyChain1
  source 1..1344: mol_type = other RNA
caggtggagctggtggagagcggcggcggcgtggtgcagcccggcagaagccagagactgagctgcgccgccagcggcttcaccttcagcagctacggcatgcactgggtgagacaggcccccggcaagggcctggagtgggtggccatcatctggttcgacggcagcagcacctactacgccgacagcgtgagaggcagattcaccatcagcagagacaacagcaagaacaccctgtacctgcagatgaacagcctgagagccgaggacaccgccgtgtacttctgcgccagagagctgggcagaagatacttcgacctgtggggcagaggcaccctggtgagcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31416 - RNA, 645 nt, synthetic construct
  misc_feature 1..645: note = derived and/or modified sequence opt4 from Teprotumumab_LightChain1
  source 1..645: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaagagagccaccggcatccccgccagattcagcggcagcggcagcggcaccgacttcaccctgaccatcagcagcctggagcccgaggacttcgccgtgtactactgccagcagagaagcaagtggcccccctggaccttcggccagggcaccaaggtggagagcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31417 - RNA, 1338 nt, synthetic construct
  misc_feature 1..1338: note = derived and/or modified sequence opt4 from Tesidolumab_HeavyChain1
  source 1..1338: mol_type = other RNA
gaggtgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcggccccttcttcggcaccgccaactacgcccagaagttccagggcagagtgaccatcaccgccgacgagagcaccagcaccgcctacatggagctgagcagcctgagaagcgaggacaccgccgtgtactactgcgccagagacaccccctacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31418 - RNA, 642 nt, synthetic construct
  misc_feature 1..642: note = derived and/or modified sequence opt4 from Tesidolumab_LightChain1
  source 1..642: mol_type = other RNA
agctacgagctgacccagcccctgagcgtgagcgtggccctgggccagaccgccagaatcacctgcagcggcgacagcatccccaactactacgtgtactggtaccagcagaagcccggccaggcccccgtgctggtgatctacgacgacagcaacagacccagcggcatccccgagagattcagcggcagcaacagcggcaacaccgccaccctgaccatcagcagagcccaggccggcgacgaggccgactactactgccagagcttcgacagcagcctgaacgccgaggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31419 - RNA, 1344 nt, synthetic construct
  misc_feature 1..1344: note = derived and/or modified sequence opt4 from Tezepelumab_HeavyChain1
  source 1..1344: mol_type = other RNA
cagatgcagctggtggagagcggcggcggcgtggtgcagcccggcagaagcctgagactgagctgcgccgccagcggcttcaccttcagaacctacggcatgcactgggtgagacaggcccccggcaagggcctggagtgggtggccgtgatctggtacgacggcagcaacaagcactacgccgacagcgtgaagggcagattcaccatcaccagagacaacagcaagaacaccctgaacctgcagatgaacagcctgagagccgaggacaccgccgtgtactactgcgccagagccccccagtgggagctggtgcacgaggccttcgacatctggggccagggcaccatggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31420 - RNA, 642 nt, synthetic construct
  misc_feature 1..642: note = derived and/or modified sequence opt4 from Tezepelumab_LightChain1
  source 1..642: mol_type = other RNA
agctacgtgctgacccagccccccagcgtgagcgtggcccccggccagaccgccagaatcacctgcggcggcaacaacctgggcagcaagagcgtgcactggtaccagcagaagcccggccaggcccccgtgctggtggtgtacgacgacagcgacagacccagctggatccccgagagattcagcggcagcaacagcggcaacaccgccaccctgaccatcagcagaggcgaggccggcgacgaggccgactactactgccaggtgtgggacagcagcagcgaccacgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31421 - RNA, 1338 nt, synthetic construct
  misc_feature 1..1338: note = derived and/or modified sequence opt4 from ThioMAb-chMA79b-HC(A118C)_HeavyChain
  source 1..1338: mol_type = other RNA
gaggtgcagctgcagcagagcggcgccgagctgatgaagcccggcgccagcgtgaagatcagctgcaaggccaccggctacaccttcagcagctactggatcgagtgggtgaagcagagacccggccacggcctggagtggatcggcgagatcctgcccggcggcggcgacaccaactacaacgagatcttcaagggcaaggccaccttcaccgccgacaccagcagcaacaccgcctacatgcagctgagcagcctgaccagcgaggacagcgccgtgtactactgcaccagaagagtgcccgtgtacttcgactactggggccagggcaccagcgtgaccgtgagcagctgcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31422 - RNA, 1347 nt, synthetic construct
  misc_feature 1..1347: note = derived and/or modified sequence opt4 from ThioMab-hu10A8.v1-HC(A118C)_HeavyChain
  source 1..1347: mol_type = other RNA
gaggtgcagctggtggagagcggcggcggcctggtgcagcccggcggcagcctgagactgagctgcgccgccagcggcttcaccttcagcagctacgccgtgagctgggtgagacaggcccccggcaagggcctggagtgggtggccaccatcagcagcggcggcagcctgaccttctacctggacagcgtgagaggcagattcaccatcagcagagacaacagcaagaacaccctgtacctgcagatgaacagcctgagagccgaggacaccgccgtgtactactgcgccagacccatccccgactactacgccctggactactggggccagggcaccctggtgaccgtgagcagctgcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31423 - RNA, 1347 nt, synthetic construct
  misc_feature 1..1347: note = derived and/or modified sequence opt4 from ThioMab-hu10A8.v1-HC(V205C)_HeavyChain
  source 1..1347: mol_type = other RNA
gaggtgcagctggtggagagcggcggcggcctggtgcagcccggcggcagcctgagactgagctgcgccgccagcggcttcaccttcagcagctacgccgtgagctgggtgagacaggcccccggcaagggcctggagtgggtggccaccatcagcagcggcggcagcctgaccttctacctggacagcgtgagaggcagattcaccatcagcagagacaacagcaagaacaccctgtacctgcagatgaacagcctgagagccgaggacaccgccgtgtactactgcgccagacccatccccgactactacgccctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31424 - RNA, 642 nt, synthetic construct
  misc_feature 1..642: note = derived and/or modified sequence opt4 from ThioMab-hu10A8.v1-LC(A118C)_LightChain
  source 1..642: mol_type = other RNA
gacatccagatgacccagagccccagcagcctgagcgccagcgtgggcgacagagtgaccatcacctgcaaggccagccaggacgtgagcaccgccgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagcacttcagcagccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31425 - RNA, 642 nt, synthetic construct
  misc_feature 1..642: note = derived and/or modified sequence opt4 from ThioMab-hu10A8.v1-LC(V205C)_LightChain
  source 1..642: mol_type = other RNA
gacatccagatgacccagagccccagcagcctgagcgccagcgtgggcgacagagtgaccatcacctgcaaggccagccaggacgtgagcaccgccgtggcctggtaccagcagaagcccggcaaggcccccaagctgctgatctacagcgccagctacagatacaccggcgtgcccagcagattcagcggcagcggcagcggcaccgacttcaccctgaccatcagcagcctgcagcccgaggacttcgccacctactactgccagcagcacttcagcagccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagcccctgcaccaagagcttcaacagaggcgagtgc

SEQ ID NO: 31426 - RNA, 1338 nt, synthetic construct
  misc_feature 1..1338: note = derived and/or modified sequence opt4 from ThioMAb-huMA79b.v17-HC(A118C)_HeavyChain
  source 1..1338: mol_type = other RNA
gaggtgcagctggtggagagcggcggcggcctggtgcagcccggcggcagcctgagactgagctgcgccgccagcggctacaccttcagcagctactggatcgagtgggtgagacaggcccccggcaagggcctggagtggatcggcgagatcctgcccggcggcggcgacaccaactacaacgagatcttcaagggcagagccaccttcagcgccgacaccagcaagaacaccgcctacctgcagatgaacagcctgagagccgaggacaccgccgtgtactactgcaccagaagagtgcccgtgtacttcgactactggggccagggcaccctggtgaccgtgagcagctgcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31427 - RNA, 654 nt, synthetic construct
  misc_feature 1..654: note = derived and/or modified sequence opt4 from ThioMAb-huMA79b.v17-HC(A118C)_LightChain
  source 1..654: mol_type = other RNA
gacatccagctgacccagagccccagcagcctgagcgccagcgtgggcgacagagtgaccatcacctgcaaggccagccagagcgtggactacgacggcgacagcttcctgaactggtaccagcagaagcccggcaaggcccccaagctgctgatctacgccgccagcaacctggagagcggcgtgcccagcagattcagcggcagcggcagcggcaccgacttcaccctgaccatcagcagcctgcagcccgaggacttcgccacctactactgccagcagagcaacgaggaccccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31428 - RNA, 1338 nt, synthetic construct
  misc_feature 1..1338: note = derived and/or modified sequence opt4 from ThioMAb-huMA79b.v18-HC(A118C)_HeavyChain
  source 1..1338: mol_type = other RNA
gaggtgcagctggtggagagcggcggcggcctggtgcagcccggcggcagcctgagactgagctgcgccgccagcggctacaccttcagcagctactggatcgagtgggtgagacaggcccccggcaagggcctggagtggatcggcgagatcctgcccggcggcggcgacaccaactacaacgagatcttcaagggcagagccaccttcagcgccgacaccagcaagaacaccgcctacctgcagatgaacagcctgagagccgaggacaccgccgtgtactactgcaccagaagagtgcccatcagactggactactggggccagggcaccctggtgaccgtgagcagctgcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31429 - RNA, 654 nt, synthetic construct; identical to SEQ ID NO: 31273
  misc_feature 1..654: note = derived and/or modified sequence opt4 from ThioMAb-huMA79b.v28-HC(A118C)_LightChain
  source 1..654: mol_type = other RNA

SEQ ID NO: 31430 - RNA, 654 nt, synthetic construct
  misc_feature 1..654: note = derived and/or modified sequence opt4 from ThioMAb-huMA79b.v28-LC(V205C)_LightChain
  source 1..654: mol_type = other RNA
gacatcgtgctgacccagagccccgccagcctggccgtgagcctgggccagagagccaccatcagctgcaaggccagccagagcgtggactacgacggcgacagcttcctgaactggtaccagcagaagcccggccagccccccaagctgttcatctacgccgccagcaacctggagagcggcatccccgccagattcagcggcagcggcagcggcaccgacttcaccctgaacatccaccccgtggaggaggaggacgccgccacctactactgccagcagagcaacgaggaccccctgaccttcggcgccggcaccgagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagcccctgcaccaagagcttcaacagaggcgagtgc

SEQ ID NO: 31431 - RNA, 1332 nt, synthetic construct
  misc_feature 1..1332: note = derived and/or modified sequence opt4 from Ticiliuab_HeavyChain1
  source 1..1332: mol_type = other RNA
caggtgcagctggtggagagcggcggcggcgtggtgcagcccggcagaagcctgagactgagctgcgccgccagcggcttcaccttcagcagctacggccactgggtgagacaggcccccggcaagggcctggagtgggtggccgtgatctggtacgacggcagcaacaagtactacgccgacagcgtgaagggcagattcaccatcagcagagacaacagcaagaacaccctgtacctgcagaacagcctgagagccgaggacaccgccgtgtactactgcgccagagaccccagaggcgccaccctgtactactactactacggcgacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 31432 - RNA, 639 nt, synthetic construct
  misc_feature 1..639: note = derived and/or modified sequence opt4 from Ticiliuab_LightChain1
  source 1..639: mol_type = other RNA
gacatccagacccagagccccagcagcctgagcgccagcgtgggcgacagagtgaccatcacctgcagagccagccagagcatcaacagctacctggactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagtactacagcacccccttcaccttcggccccggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31433 - RNA, 1347 nt, synthetic construct
  misc_feature 1..1347: note = derived and/or modified sequence opt4 from Tigatuzumab_HeavyChain1
  source 1..1347: mol_type = other RNA
gaggtgcagctggtggagagcggcggcggcctggtgcagcccggcggcagcctgagactgagctgcgccgccagcggcttcaccttcagcagctacgtgatgagctgggtgagacaggcccccggcaagggcctggagtgggtggccaccatcagcagcggcggcagctacacctactaccccgacagcgtgaagggcagattcaccatcagcagagacaacgccaagaacaccctgtacctgcagatgaacagcctgagagccgaggacaccgccgtgtactactgcgccagaagaggcgacagcatgatcaccaccgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31434 - RNA, 1347 nt, synthetic construct; identical to SEQ ID NO: 31433
  misc_feature 1..1347: note = derived and/or modified sequence opt4 from Tigatuzumab_HeavyChain
  source 1..1347: mol_type = other RNA

SEQ ID NO: 31435 - RNA, 639 nt, synthetic construct
  misc_feature 1..639: note = derived and/or modified sequence opt4 from Tigatuzumab_LightChain1
  source 1..639: mol_type = other RNA
gacatccagatgacccagagccccagcagcctgagcgccagcgtgggcgacagagtgaccatcacctgcaaggccagccaggacgtgggcaccgccgtggcctggtaccagcagaagcccggcaaggcccccaagctgctgatctactgggccagcaccagacacaccggcgtgcccagcagattcagcggcagcggcagcggcaccgacttcaccctgaccatcagcagcctgcagcccgaggacttcgccacctactactgccagcagtacagcagctacagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31436 - RNA, 639 nt, synthetic construct; identical to SEQ ID NO: 31435
  misc_feature 1..639: note = derived and/or modified sequence opt4 from Tigatuzumab_LightChain
  source 1..639: mol_type = other RNA

SEQ ID NO: 31437 - RNA, 1338 nt, synthetic construct
  misc_feature 1..1338: note = derived and/or modified sequence opt4 from Tildrakizumab_HeavyChain1
  source 1..1338: mol_type = other RNA
caggtgcagctggtgcagagcggcgccgaggtgaagaagcccggcgccagcgtgaaggtgagctgcaaggccagcggctacatcttcatcacctactggatgacctgggtgagacaggcccccggccagggcctggagtggatgggccagatcttccccgccagcggcagcgccgactacaacgagaagttcgagggcagagtgaccatgaccaccgacaccagcaccagcaccgcctacatggagctgagaagcctgagaagcgacgacaccgccgtgtactactgcgccagaggcggcggcggcttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31438 - RNA, 642 nt, synthetic construct
  misc_feature 1..642: note = derived and/or modified sequence opt4 from Tildrakizumab_LightChain1
  source 1..642: mol_type = other RNA
gacatccagatgacccagagccccagcagcctgagcgccagcgtgggcgacagagtgaccatcacctgcagaaccagcgagaacatctacagctacctggcctggtaccagcagaagcccggcaaggcccccaagctgctgatctacaacgccaagaccctggccgagggcgtgcccagcagattcagcggcagcggcagcggcaccgacttcaccctgaccatcagcagcctgcagcccgaggacttcgccacctactactgccagcaccactacggcatccccttcaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31439 - RNA, 1344 nt, synthetic construct
  misc_feature 1..1344: note = derived and/or modified sequence opt4 from Tisotumab_vedotin_HeavyChain1
  source 1..1344: mol_type = other RNA
gaggtgcagctgctggagagcggcggcggcctggtgcagcccggcggcagcctgagactgagctgcgccgccagcggcttcaccttcagcaactacgccatgagctgggtgagacaggcccccggcaagggcctggagtgggtgagcagcatcagcggcagcggcgactacacctactacaccgacagcgtgaagggcagattcaccatcagcagagacaacagcaagaacaccctgtacctgcagatgaacagcctgagagccgaggacaccgccgtgtactactgcgccagaagcccctggggctactacctggacagctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31440 - RNA, 642 nt, synthetic construct
  misc_feature 1..642: note = derived and/or modified sequence opt4 from Tisotumab_vedotin_LightChain1
  source 1..642: mol_type = other RNA
gacatccagatgacccagagcccccccagcctgagcgccagcgccggcgacagagtgaccatcacctgcagagccagccagggcatcagcagcagactggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31441 - RNA, 1341 nt, synthetic construct
  misc_feature 1..1341: note = derived and/or modified sequence opt4 from Tocilizumab_HeavyChain1
  source 1..1341: mol_type = other RNA
gtgcagctgcaggagagcggccccggcctggtgagacccagccagaccctgagcctgacctgcaccgtgagcggctacagcatcaccagcgaccacgcctggagctgggtgagacagccccccggcagaggcctggagtggatcggctacatcagctacagcggcatcaccacctacaaccccagcctgaagagcagagtgaccatgctgagagacaccagcaagaaccagttcagcctgagactgagcagcgtgaccgccgccgacaccgccgtgtactactgcgccagaagcctggccagaaccaccgccatggactactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31442 - RNA, 642 nt, synthetic construct
  misc_feature 1..642: note = derived and/or modified sequence opt4 from Tocilizumab_LightChain1
  source 1..642: mol_type = other RNA
gacatccagatgacccagagccccagcagcctgagcgccagcgtgggcgacagagtgaccatcacctgcagagccagccaggacatcagcagctacctgaactggtaccagcagaagcccggcaaggcccccaagctgctgatctactacaccagcagactgcacagcggcgtgcccagcagattcagcggcagcggcagcggcaccgacttcaccttcaccatcagcagcctgcagcccgaggacatcgccacctactactgccagcagggcaacaccctgccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31443 - RNA, 1353 nt, synthetic construct
  misc_feature 1..1353: note = derived and/or modified sequence opt4 from Tosatoxumab_HeavyChain1
  source 1..1353: mol_type = other RNA
gaggtgcagatggtgcagagcggcgccgaggtgaagaagcccggcgagcccctgaagatcagctgcaagggcagcggctacaagttcggcacccactggatcggctgggtgagacagagacccggcaagggcctggagtggatgggcatcatccaccccgccgacagcgagaccaagtacagccccagcttccagggccaggtgagcttcagcgccgacaagagcagcaacaccgcctacctgcactggagcaccctgagagccagcgacaccgccatgtactactgcgccagaagaagcggcagcagcagctggtacgccctggacttctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31444 - RNA, 651 nt, synthetic construct
  misc_feature 1..651: note = derived and/or modified sequence opt4 from Tosatoxumab_LightChain1
  source 1..651: mol_type = other RNA
cagagcgtgctgacccagagccccagcgccagcggcacccccggccagagagtgaccatcagctgcagcggcggcagcagcaacatcggcagcaacaccgtgaactggtaccagcagttccccggcgccgcccccaagctgctgatctacaccaacaaccagagacccagcggcgtgcccgacagattcagcggcagcaagagcggcaccagcgccagcctggccatcagcggcctgcagagcgaggacgaggccgactactactgcgccacctgggacgacagcctgaacggcctgtacgtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31445 - RNA, 1341 nt, synthetic construct
  misc_feature 1..1341: note = derived and/or modified sequence opt4 from Tositumomab_HeavyChain
  source 1..1341: mol_type = other RNA
caggcctacctgcagcagagcggcgccgagctggtgagacccggcgccagcgtgaagatgagctgcaaggccagcggctacaccttcaccagctacaacatgcactgggtgaagcagacccccagacagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagagtggtgtactacagcaacagctactggtacttcgacgtgtggggcaccggcaccaccgtgaccgtgagcggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31446 - RNA, 630 nt, synthetic construct
  misc_feature 1..630: note = derived and/or modified sequence opt4 from Tositumomab_LightChain
  source 1..630: mol_type = other RNA
cagatcgtgctgagccagagccccgccatcctgagcgccagccccggcgagaaggtgaccatgacctgcagagccagcagcagcgtgagctacatgcactggtaccagcagaagcccggcagcagccccaagccctggatctacgcccccagcaacctggccagcggcgtgcccgccagattcagcggcagcggcagcggcaccagctacagcctgaccatcagcagagtggaggccgaggacgccgccacctactactgccagcagtggagcttcaacccccccaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 31447 - RNA, 1338 nt, synthetic construct
  misc_feature 1..1338: note = derived and/or modified sequence opt4 from Tovetumab_HeavyChain1
  source 1..1338: mol_type = other RNA
caggtgcagctggtggagagcggcggcggcctggtgaagcccggcggcagcctgagactgagctgcgccgccagcggcttcaccttcagcgactactacatgaactggatcagacaggcccccggcaagggcctggagtgggtgagctacatcagcagcagcggcagcatcatctactacgccgacagcgtgaagggcagattcaccatcagcagagacaacgccaagaacagcctgtacctgcagatgaacagcctgagagccgaggacaccgccgtgtactactgcgccagagagggcagaatcgccgccagaggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31448 - RNA, 645 nt, synthetic construct
  misc_feature 1..645: note = derived and/or modified sequence opt4 from Tovetumab_LightChain1
  source 1..645: mol_type = other RNA
gacatccagatgacccagagccccagcagcctgagcgccagcgtgggcgacagagtgagcatcacctgcagacccagccagagcttcagcagatacatcaactggtaccagcagaagcccggcaaggcccccaagctgctgatccacgccgccagcagcctggtgggcggcgtgcccagcagattcagcggcagcggcagcggcaccgacttcaccctgaccatcagcagcctgcagcccgaggacttcgccacctactactgccagcagacctacagcaacccccccatcaccttcggccagggcaccagactggagatgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31449 - RNA, 1347 nt, synthetic construct
  misc_feature 1..1347: note = derived and/or modified sequence opt4 from Tralokinumab_HeavyChain1
  source 1..1347: mol_type = other RNA
caggtgcagctggtgcagagcggcgccgaggtgaagaagcccggcgccagcgtgaaggtgagctgcaaggccagcggctacaccttcaccaactacggcctgagctgggtgagacaggcccccggccagggcctggagtggatgggctggatcagcgccaacaacggcgacaccaactacggccaggagttccagggcagagtgaccatgaccaccgacaccagcaccagcaccgcctacatggagctgagaagcctgagaagcgacgacaccgccgtgtactactgcgccagagacagcagcagcagctgggccagatggttcttcgacctgtggggcagaggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31450 - RNA, 642 nt, synthetic construct
  misc_feature 1..642: note = derived and/or modified sequence opt4 from Tralokinumab_LightChain1
  source 1..642: mol_type = other RNA
agctacgtgctgacccagccccccagcgtgagcgtggcccccggcaagaccgccagaatcacctgcggcggcaacatcatcggcagcaagctggtgcactggtaccagcagaagcccggccaggcccccgtgctggtgatctacgacgacggcgacagacccagcggcatccccgagagattcagcggcagcaacagcggcaacaccgccaccctgaccatcagcagagtggaggccggcgacgaggccgactactactgccaggtgtgggacaccggcagcgaccccgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31451 - RNA, 1332 nt, synthetic construct
  misc_feature 1..1332: note = derived and/or modified sequence opt4 from Trastuzuab_HeavyChain1
  source 1..1332: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagaacagcctgagagccgaggacaccgccgtgtactactgcagcagatggggcggcgacggcttctacgccgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggc

SEQ ID NO: 31452 - RNA, 639 nt, synthetic construct
  misc_feature 1..639: note = derived and/or modified sequence opt4 from Trastuzuab_LightChain1
  source 1..639: mol_type = other RNA
gacatccagacccagagccccagcagcctgagcgccagcgtgggcgacagagtgaccatcacctgcagagccagccaggacgtgaacaccgccgtggcctggtaccagcagaagcccggcaaggcccccaagctgctgatctacagcgccagcttcctgtacagcggcgtgcccagcagattcagcggcagcagaagcggcaccgacttcaccctgaccatcagcagcctgcagcccgaggacttcgccacctactactgccagcagcactacaccaccccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31453 - RNA, 1347 nt, synthetic construct
  misc_feature 1..1347: note = derived and/or modified sequence opt4 from Trastuzumab_emtansine_HeavyChain1
  source 1..1347: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31454 - RNA, 642 nt, synthetic construct; identical to SEQ ID NO: 31310
  misc_feature 1..642: note = derived and/or modified sequence opt4 from Trastuzumab_emtansine_LightChain1
  source 1..642: mol_type = other RNA

SEQ ID NO: 31455 - RNA, 1347 nt, synthetic construct; identical to SEQ ID NO: 31453
  misc_feature 1..1347: note = derived and/or modified sequence opt4 from Trastuzumab_HeavyChain1
  source 1..1347: mol_type = other RNA

SEQ ID NO: 31456 - RNA, 1353 nt, synthetic construct
  misc_feature 1..1353: note = derived and/or modified sequence opt4 from Trastuzumab_HeavyChain
  source 1..1353: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccccccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31457 - RNA, 660 nt, synthetic construct
  misc_feature 1..660: note = derived and/or modified sequence opt4 from Trastuzumab_HeavyChain_variant_1n8z_B
  source 1..660: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccc

SEQ ID NO: 31458 - RNA, 45 nt, synthetic construct
  misc_feature 1..45: note = derived and/or modified sequence opt4 from Trastuzumab_HeavyChain_variant_7637_H
  source 1..45: mol_type = other RNA
gagcccaagagctgcgacaagacccacacctgccccccctgcccc

SEQ ID NO: 31459 - RNA, 642 nt, synthetic construct; identical to SEQ ID NO: 31310
  misc_feature 1..642: note = derived and/or modified sequence opt4 from Trastuzumab_LightChain1
  source 1..642: mol_type = other RNA

SEQ ID NO: 31460 - RNA, 642 nt, synthetic construct; identical to SEQ ID NO: 31310
  misc_feature 1..642: note = derived and/or modified sequence opt4 from Trastuzumab_LightChain_variant_1n8z_A
  source 1..642: mol_type = other RNA

SEQ ID NO: 31461 - RNA, 642 nt, synthetic construct; identical to SEQ ID NO: 31310
  misc_feature 1..642: note = derived and/or modified sequence opt4 from Trastuzumab_LightChain_variant_7637_L
  source 1..642: mol_type = other RNA

SEQ ID NO: 31462 - RNA, 1344 nt, synthetic construct
  misc_feature 1..1344: note = derived and/or modified sequence opt4 from TRC-105_HeavyChain1
  source 1..1344: mol_type = other RNA
gaggtgaagctggaggagagcggcggcggcctggtgcagcccggcggcagcatgaagctgagctgcgccgccagcggcttcaccttcagcgacgcctggatggactgggtgagacagagccccgagaagggcctggagtgggtggccgagatcagaagcaaggccagcaaccacgccacctactacgccgagagcgtgaagggcagattcaccatcagcagagacgacagcaagagcagcgtgtacctgcagatgaacagcctgagagccgaggacaccggcatctactactgcaccagatggagaagattcttcgacagctggggccagggcaccaccctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31463 - RNA, 639 nt, synthetic construct
  misc_feature 1..639: note = derived and/or modified sequence opt4 from TRC-105_LightChain1
  source 1..639: mol_type = other RNA
cagatcgtgctgagccagagccccgccatcctgagcgccagccccggcgagaaggtgaccatgacctgcagagccagcagcagcgtgagctacatgcactggtaccagcagaagcccggcagcagccccaagccctggatctacgccaccagcaacctggccagcggcgtgcccgtgagattcagcggcagcggcagcggcaccagctacagcctgaccatcagcagagtggaggccgaggacgccgccacctactactgccagcagtggagcagcaaccccctgaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31464 - RNA, 1362 nt, synthetic construct
  misc_feature 1..1362: note = derived and/or modified sequence opt4 from Tregalizumab_HeavyChain1
  source 1..1362: mol_type = other RNA
gaggagcagctggtggagagcggcggcggcctggtgaagcccggcggcagcctgagactgagctgcgccgccagcggcttcagcttcagcgactgcagaatgtactggctgagacaggcccccggcaagggcctggagtggatcggcgtgatcagcgtgaagagcgagaactacggcgccaactacgccgagagcgtgagaggcagattcaccatcagcagagacgacagcaagaacaccgtgtacctgcagatgaacagcctgaagaccgaggacaccgccgtgtactactgcagcgccagctactacagatacgacgtgggcgcctggttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31465 - RNA, 654 nt, synthetic construct
  misc_feature 1..654: note = derived and/or modified sequence opt4 from Tregalizumab_LightChain1
  source 1..654: mol_type = other RNA
gacatcgtgatgacccagagccccgacagcctggccgtgagcctgggcgagagagccaccatcaactgcagagccagcaagagcgtgagcaccagcggctacagctacatctactggtaccagcagaagcccggccagccccccaagctgctgatctacctggccagcatcctggagagcggcgtgcccgacagattcagcggcagcggcagcggcaccgacttcaccctgaccatcagcagcctgcaggccgaggacgtggccgtgtactactgccagcacagcagagagctgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31466 - RNA, 1353 nt, synthetic construct
  misc_feature 1..1353: note = derived and/or modified sequence opt4 from Tremelimumab_HeavyChain1
  source 1..1353: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatctggtacgacggcagcaacaagtactacgccgacagcgtgaagggcagattcaccatcagcagagacaacagcaagaacaccctgtacctgcagatgaacagcctgagagccgaggacaccgccgtgtactactgcgccagagaccccagaggcgccaccctgtactactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31467 - RNA, 642 nt, synthetic construct
  misc_feature 1..642: note = derived and/or modified sequence opt4 from Tremelimumab_LightChain1
  source 1..642: mol_type = other RNA
gacatccagatgacccagagccccagcagcctgagcgccagcgtgggcgacagagtgaccatcacctgcagagccagccagagcatcaacagctacctggactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagtactacagcacccccttcaccttcggccccggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31468 - RNA, 1341 nt, synthetic construct
  misc_feature 1..1341: note = derived and/or modified sequence opt4 from Trevogrumab_HeavyChain1
  source 1..1341: mol_type = other RNA
gaggtgcaggtgctggagagcggcggcgacctggtgcagcccggcggcagcctgagactgagctgcgccgccagcggcttcaccttcagcgcctacgccatgacctgggtgagacaggcccccggcaagggcctggagtgggtgagcgccatcagcggcagcggcggcagcgcctactacgccgacagcgtgaagggcagattcaccatcagcagagacaacagcaagaacaccgtgtacctgcagatgaacagcctgagagccgaggacaccgccgtgtactactgcgccaaggacggcgcctggaagatgagcggcctggacgtgtggggccagggcaccaccgtgatcgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31469 - RNA, 642 nt, synthetic construct
  misc_feature 1..642: note = derived and/or modified sequence opt4 from Trevogrumab_LightChain1
  source 1..642: mol_type = other RNA
gacatccagatgacccagagccccgccagcctgagcgccagcgtgggcgacagagtgaccatcacctgcagagccagccaggacatcagcgactacctggcctggtaccagcagaagcccggcaagatccccagactgctgatctacaccaccagcaccctgcagagcggcgtgcccagcagattcagaggcagcggcagcggcaccgacttcaccctgaccatcagcagcctgcagcccgaggacgtggccacctactactgccagaagtacgacagcgcccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31470 - RNA, 1737 nt, synthetic construct
  misc_feature 1..1737: note = derived and/or modified sequence opt4 from Tucotuzumab_celmoleukin_HeavyChain1
  source 1..1737: mol_type = other RNA
cagatccagctggtgcagagcggcgccgaggtgaagaagcccggcgagaccgtgaagatcagctgcaaggccagcggctacaccttcaccaactacggcatgaactgggtgaagcagacccccggcaagggcctgaagtggatgggctggatcaacacctacaccggcgagcccacctacgccgacgacttcaagggcagattcgccttcagcctggagaccagcaccagcaccgccttcctgcagatcaacaacctgagaagcgaggacaccgccacctacttctgcgtgagattcatcagcaagggcgactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaaggcccccaccagcagcagcaccaagaagacccagctgcagctggagcacctgctgctggacctgcagatgatcctgaacggcatcaacaactacaagaaccccaagctgaccagaatgctgaccttcaagttctacatgcccaagaaggccaccgagctgaagcacctgcagtgcctggaggaggagctgaagcccctggaggaggtgctgaacctggcccagagcaagaacttccacctgagacccagagacctgatcagcaacatcaacgtgatcgtgctggagctgaagggcagcgagaccaccttcatgtgcgagtacgccgacgagaccgccaccatcgtggagttcctgaacagatggatcaccttctgccagagcatcatcagcaccctgacc

SEQ ID NO: 31471 - RNA, 639 nt, synthetic construct
  misc_feature 1..639: note = derived and/or modified sequence opt4 from Tucotuzumab_celmoleukin_LightChain1
  source 1..639: mol_type = other RNA
gagatcgtgctgacccagagccccgccaccctgagcctgagccccggcgagagagtgaccctgacctgcagcgccagcagcagcgtgagctacatgctgtggtaccagcagaagcccggcagcagccccaagccctggatcttcgacaccagcaacctggccagcggcttccccgccagattcagcggcagcggcagcggcaccagctacagcctgatcatcagcagcatggaggccgaggacgccgccacctactactgccaccagagaagcggctacccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31472 - RNA, 1344 nt, synthetic construct
  misc_feature 1..1344: note = derived and/or modified sequence opt4 from Ublituximab_HeavyChain1
  source 1..1344: mol_type = other RNA
caggcctacctgcagcagagcggcgccgagctggtgagacccggcgccagcgtgaagatgagctgcaaggccagcggctacaccttcaccagctacaacatgcactgggtgaagcagacccccagacagggcctggagtggatcggcggcatctaccccggcaacggcgacaccagctacaaccagaagttcaagggcaaggccaccctgaccgtgggcaagagcagcagcaccgcctacatgcagctgagcagcctgaccagcgaggacagcgccgtgtacttctgcgccagatacgactacaactacgccatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31473 - RNA, 639 nt, synthetic construct
  misc_feature 1..639: note = derived and/or modified sequence opt4 from Ublituximab_LightChain1
  source 1..639: mol_type = other RNA
cagatcgtgctgagccagagccccgccatcctgagcgccagccccggcgagaaggtgaccatgacctgcagagccagcagcagcgtgagctacatgcactggtaccagcagaagcccggcagcagccccaagccctggatctacgccaccagcaacctggccagcggcgtgcccgccagattcagcggcagcggcagcggcaccagctacagcttcaccatcagcagagtggaggccgaggacgccgccacctactactgccagcagtggaccttcaacccccccaccttcggcggcggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31474 - RNA, 1353 nt, synthetic construct
  misc_feature 1..1353: note = derived and/or modified sequence opt4 from Ulocuplumab_HeavyChain1
  source 1..1353: mol_type = other RNA
gaggtgcagctggtggagagcggcggcggcctggtgcagcccggcggcagcctgagactgagctgcgccgccgccggcttcaccttcagcagctacagcatgaactgggtgagacaggcccccggcaagggcctggagtgggtgagctacatcagcagcagaagcagaaccatctactacgccgacagcgtgaagggcagattcaccatcagcagagacaacgccaagaacagcctgtacctgcagatgaacagcctgagagacgaggacaccgccgtgtactactgcgccagagactacggcggccagcccccctactactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 31475 - RNA, 642 nt, synthetic construct
  misc_feature 1..642: note = derived and/or modified sequence opt4 from Ulocuplumab_LightChain1
  source 1..642: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgtgacctactactgccagcagtacaacagctaccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31476 - RNA, 1344 nt, synthetic construct
  misc_feature 1..1344: note = derived and/or modified sequence opt4 from Urelumab_HeavyChain1
  source 1..1344: mol_type = other RNA
caggtgcagctgcagcagtggggcgccggcctgctgaagcccagcgagaccctgagcctgacctgcgccgtgtacggcggcagcttcagcggctactactggagctggatcagacagagccccgagaagggcctggagtggatcggcgagatcaaccacggcggctacgtgacctacaaccccagcctggagagcagagtgaccatcagcgtggacaccagcaagaaccagttcagcctgaagctgagcagcgtgaccgccgccgacaccgccgtgtactactgcgccagagactacggccccggcaactacgactggtacttcgacctgtggggcagaggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31477 - RNA, 648 nt, synthetic construct
  misc_feature 1..648: note = derived and/or modified sequence opt4 from Urelumab_LightChain1
  source 1..648: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggccccccgccctgaccttctgcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31478 - RNA, 1347 nt, synthetic construct
  misc_feature 1..1347: note = derived and/or modified sequence opt4 from Urtoxazumab_HeavyChain1
  source 1..1347: mol_type = other RNA
gaggtgcagctggtggagagcggcggcggcctggtgcagcccggcggcagcctgagactgagctgcgccgccagcggcttcaccttcagcagctacggcatgagctgggtgagacaggcccccggcaagggcctggagtgggtggccaccatcagcaccggcggcagctacacctactaccccgacagcgtgaagggcagattcaccatcagcagagacaacgccaagaacaccctgtacctgcagatgaacagcctgagagccgaggacaccgccgtgtactactgcgccagaagaggcgacgcctggggcaacctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31479 - RNA, 642 nt, synthetic construct
  misc_feature 1..642: note = derived and/or modified sequence opt4 from Urtoxazumab_LightChain1
  source 1..642: mol_type = other RNA
gagatcgtgctgacccagagccccgccaccctgagcgtgagccccggcgagagagccaccctgagctgcagagccagccagaccatcagcaacaacctgcactggtaccagcagaagcccggccaggcccccagactgctgatcaagagcgccagccagagcatcagcggcatccccgccagattcagcggcagcggcagcggcaccgacttcaccctgaccatcagcagcctggagagcgaggacttcgccgtgtactactgccagcagagctacagctggcccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31480 - RNA, 1347 nt, synthetic construct
  misc_feature 1..1347: note = derived and/or modified sequence opt4 from Ustekinumab_HeavyChain1
  source 1..1347: mol_type = other RNA
gaggtgcagctggtgcagagcggcgccgaggtgaagaagcccggcgagagcctgaagatcagctgcaagggcagcggctacagcttcaccacctactggctgggctgggtgagacagatgcccggcaagggcctggactggatcggcatcatgagccccgtggacagcgacatcagatacagccccagcttccagggccaggtgaccatgagcgtggacaagagcatcaccaccgcctacctgcagtggaacagcctgaaggccagcgacaccgccatgtactactgcgccagaagaagacccggccagggctacttcgacttctggggccagggcaccctggtgaccgtgagcagcagcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31481 - RNA, 642 nt, synthetic construct
  misc_feature 1..642: note = derived and/or modified sequence opt4 from Ustekinumab_LightChain1
  source 1..642: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacatctacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31482 - RNA, 1341 nt, synthetic construct
  misc_feature 1..1341: note = derived and/or modified sequence opt4 from Vadastuximab_talirine_HeavyChain1
  source 1..1341: mol_type = other RNA
caggtgcagctggtgcagagcggcgccgaggtgaagaagcccggcgccagcgtgaaggtgagctgcaaggccagcggctacaccttcaccaactacgacatcaactgggtgagacaggcccccggccagggcctggagtggatcggctggatctaccccggcgacggcagcaccaagtacaacgagaagttcaaggccaaggccaccctgaccgccgacaccagcaccagcaccgcctacatggagctgagaagcctgagaagcgacgacaccgccgtgtactactgcgccagcggctacgaggacgccatggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggcccctgcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31483 - RNA, 642 nt, synthetic construct
  misc_feature 1..642: note = derived and/or modified sequence opt4 from Vadastuximab_talirine_LightChain1
  source 1..642: mol_type = other RNA
gacatccagatgacccagagccccagcagcctgagcgccagcgtgggcgacagagtgaccatcaactgcaaggccagccaggacatcaacagctacctgagctggttccagcagaagcccggcaaggcccccaagaccctgatctacagagccaacagactggtggacggcgtgcccagcagattcagcggcagcggcagcggccaggactacaccctgaccatcagcagcctgcagcccgaggacttcgccacctactactgcctgcagtacgacgagttccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31484 - RNA, 1362 nt, synthetic construct
  misc_feature 1..1362: note = derived and/or modified sequence opt4 from Vandortuzumab_vedotin_HeavyChain1
  source 1..1362: mol_type = other RNA
gaggtgcagctggtggagagcggcggcggcctggtgcagcccggcggcagcctgagactgagctgcgccgtgagcggctacagcatcaccagcgactacgcctggaactgggtgagacaggcccccggcaagggcctggagtgggtgggctacatcagcaacagcggcagcaccagctacaaccccagcctgaagagcagattcaccatcagcagagacaccagcaagaacaccctgtacctgcagatgaacagcctgagagccgaggacaccgccgtgtactactgcgccagagagagaaactacgactacgacgactactactacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31485 - RNA, 660 nt, synthetic construct
  misc_feature 1..660: note = derived and/or modified sequence opt4 from Vandortuzumab_vedotin_LightChain1
  source 1..660: mol_type = other RNA
gacatccagatgacccagagccccagcagcctgagcgccagcgtgggcgacagagtgaccatcacctgcaagagcagccagagcctgctgtacagaagcaaccagaagaactacctggcctggtaccagcagaagcccggcaaggcccccaagctgctgatctactgggccagcaccagagagagcggcgtgcccagcagattcagcggcagcggcagcggcaccgacttcaccctgaccatcagcagcctgcagcccgaggacttcgccacctactactgccagcagtactacaactaccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31486 - RNA, 1329 nt, synthetic construct
  misc_feature 1..1329: note = derived and/or modified sequence opt4 from Vantictumab_HeavyChain1
  source 1..1329: mol_type = other RNA
gaggtgcagctggtggagagcggcggcggcctggtgcagcccggcggcagcctgagactgagctgcgccgccagcggcttcaccttcagccactacaccctgagctgggtgagacaggcccccggcaagggcctggagtgggtgagcgtgatcagcggcgacggcagctacacctactacgccgacagcgtgaagggcagattcaccatcagcagcgacaacagcaagaacaccctgtacctgcagatgaacagcctgagagccgaggacaccgccgtgtactactgcgccagaaacttcatcaagtacgtgttcgccaactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31487 - RNA, 639 nt, synthetic construct
  misc_feature 1..639: note = derived and/or modified sequence opt4 from Vantictumab_LightChain1
  source 1..639: mol_type = other RNA
gacatcgagctgacccagccccccagcgtgagcgtggcccccggccagaccgccagaatcagctgcagcggcgacaacatcggcagcttctacgtgcactggtaccagcagaagcccggccaggcccccgtgctggtgatctacgacaagagcaacagacccagcggcatccccgagagattcagcggcagcaacagcggcaacaccgccaccctgaccatcagcggcacccaggccgaggacgaggccgactactactgccagagctacgccaacaccctgagcctggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31488 - RNA, 1389 nt, synthetic construct
  misc_feature 1..1389: note = derived and/or modified sequence opt4 from Vanucizumab_HeavyChain1
  source 1..1389: mol_type = other RNA
caggtgcagctggtgcagagcggcgccgaggtgaagaagcccggcgccagcgtgaaggtgagctgcaaggccagcggctacaccttcaccggctactacatgcactgggtgagacaggcccccggccagggcctggagtggatgggctggatcaaccccaacagcggcggcaccaactacgcccagaagttccagggcagagtgaccatgaccagagacaccagcatcagcaccgcctacatggagctgagcagactgagaagcgacgacaccgccgtgtactactgcgccagaagccccaacccctactactacgacagcagcggctactactaccccggcgccttcgacatctggggccagggcaccatggtgaccgtgagcagcgccagcgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtgcaccctgccccccagcagagacgagctgaccaagaaccaggtgagcctgagctgcgccgtgaagggcttctaccccagcgacatcgccgtggagtgggagagcaacggccagcccgagaacaactacaagaccaccccccccgtgctggacagcgacggcagcttcttcctggtgagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31489 - RNA, 1359 nt, synthetic construct
  misc_feature 1..1359: note = derived and/or modified sequence opt4 from Vanucizumab_HeavyChain2
  source 1..1359: mol_type = other RNA
gaggtgcagctggtggagagcggcggcggcctggtgcagcccggcggcagcctgagactgagctgcgccgccagcggctacaccttcaccaactacggcatgaactgggtgagacaggcccccggcaagggcctggagtgggtgggctggatcaacacctacaccggcgagcccacctacgccgccgacttcaagagaagattcaccttcagcctggacaccagcaagagcaccgcctacctgcagatgaacagcctgagagccgaggacaccgccgtgtactactgcgccaagtacccccactactacggcagcagccactggtacttcgacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgcccccctgcagagacgagctgaccaagaaccaggtgagcctgtggtgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31490 - RNA, 639 nt, synthetic construct
  misc_feature 1..639: note = derived and/or modified sequence opt4 from Vanucizumab_LightChain1
  source 1..639: mol_type = other RNA
cagcccggcctgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccactacgtgttcggcaccggcaccaaggtgaccgtgctgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31491 - RNA, 642 nt, synthetic construct; identical to SEQ ID NO: 30652
  misc_feature 1..642: note = derived and/or modified sequence opt4 from Vanucizumab_LightChain2
  source 1..642: mol_type = other RNA

SEQ ID NO: 31492 - RNA, 1356 nt, synthetic construct
  misc_feature 1..1356: note = derived and/or modified sequence opt4 from Varlilumab_HeavyChain1
  source 1..1356: mol_type = other RNA
caggtgcagctggtggagagcggcggcggcgtggtgcagcccggcagaagcctgagactgagctgcgccgccagcggcttcaccttcagcagctacgacatgcactgggtgagacaggcccccggcaagggcctggagtgggtggccgtgatctggtacgacggcagcaacaagtactacgccgacagcgtgaagggcagattcaccatcagcagagacaacagcaagaacaccctgtacctgcagatgaacagcctgagagccgaggacaccgccgtgtactactgcgccagaggcagcggcaactggggcttcttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagggcagcagc

SEQ ID NO: 31493 - RNA, 642 nt, synthetic construct
  misc_feature 1..642: note = derived and/or modified sequence opt4 from Varlilumab_LightChain1
  source 1..642: mol_type = other RNA
gacatccagatgacccagagccccagcagcctgagcgccagcgtgggcgacagagtgaccatcacctgcagagccagccagggcatcagcagatggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacacctaccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31494 - RNA, 1338 nt, synthetic construct
  misc_feature 1..1338: note = derived and/or modified sequence opt4 from Vatelizumab_HeavyChain1
  source 1..1338: mol_type = other RNA
caggtgcagctgcaggagagcggccccggcctggtgaagcccagcgagaccctgagcctgacctgcaccgtgagcggcttcagcctgaccaactacggcatccactggatcagacagccccccggcaagggcctggagtggctgggcgtgatctgggccagaggcttcaccaactacaacagcgccctgatgagcagactgaccatcagcaaggacaacagcaagaaccaggtgagcctgaagctgagcagcgtgaccgccgccgacaccgccgtgtactactgcgccagagccaacgacggcgtgtactacgccatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31495 - RNA, 639 nt, synthetic construct
  misc_feature 1..639: note = derived and/or modified sequence opt4 from Vatelizumab_LightChain1
  source 1..639: mol_type = other RNA
gacttcgtgatgacccagagccccgccttcctgagcgtgacccccggcgagaaggtgaccatcacctgcagcgcccagagcagcgtgaactacatccactggtaccagcagaagcccgaccaggcccccaagaagctgatctacgacaccagcaagctggccagcggcgtgcccagcagattcagcggcagcggcagcggcaccgactacaccttcaccatcagcagcctggaggccgaggacgccgccacctactactgccagcagtggaccaccaaccccctgaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31496 - RNA, 1353 nt, synthetic construct
  misc_feature 1..1353: note = derived and/or modified sequence opt4 from Vedolizumab_HeavyChain1
  source 1..1353: mol_type = other RNA
caggtgcagctggtgcagagcggcgccgaggtgaagaagcccggcgccagcgtgaaggtgagctgcaagggcagcggctacaccttcaccagctactggatgcactgggtgagacaggcccccggccagagactggagtggatcggcgagatcgaccccagcgagagcaacaccaactacaaccagaagttcaagggcagagtgaccctgaccgtggacatcagcgccagcaccgcctacatggagctgagcagcctgagaagcgaggacaccgccgtgtactactgcgccagaggcggctacgacggctgggactacgccatcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31497 - RNA, 657 nt, synthetic construct
  misc_feature 1..657: note = derived and/or modified sequence opt4 from Vedolizumab_LightChain1
  source 1..657: mol_type = other RNA
gacgtggtgatgacccagagccccctgagcctgcccgtgacccccggcgagcccgccagcatcagctgcagaagcagccagagcctggccaagagctacggcaacacctacctgagctggtacctgcagaagcccggccagagcccccagctgctgatctacggcatcagcaacagattcagcggcgtgcccgacagattcagcggcagcggcagcggcaccgacttcaccctgaagatcagcagagtggaggccgaggacgtgggcgtgtactactgcctgcagggcacccaccagccctacaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31498 - RNA, 1353 nt, synthetic construct
  misc_feature 1..1353: note = derived and/or modified sequence opt4 from Veltuzumab_HeavyChain1
  source 1..1353: mol_type = other RNA
caggtgcagctgcagcagagcggcgccgaggtgaagaagcccggcagcagcgtgaaggtgagctgcaaggccagcggctacaccttcaccagctacaacatgcactgggtgaagcaggcccccggccagggcctggagtggatcggcgccatctaccccggcatgggcgacaccagctacaaccagaagttcaagggcaaggccaccctgaccgccgacgagagcaccaacaccgcctacatggagctgagcagcctgagaagcgaggacaccgccttctactactgcgccagaagcacctactacggcggcgactggtacttcgacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31499 - RNA, 639 nt, synthetic construct
  misc_feature 1..639: note = derived and/or modified sequence opt4 from Veltuzumab_LightChain1
  source 1..639: mol_type = other RNA
gacatccagctgacccagagccccagcagcctgagcgccagcgtgggcgacagagtgaccatgacctgcagagccagcagcagcgtgagctacatccactggttccagcagaagcccggcaaggcccccaagccctggatctacgccaccagcaacctggccagcggcgtgcccgtgagattcagcggcagcggcagcggcaccgactacaccttcaccatcagcagcctgcagcccgaggacatcgccacctactactgccagcagtggaccagcaacccccccaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31500 - RNA, 1359 nt, synthetic construct
  misc_feature 1..1359: note = derived and/or modified sequence opt4 from Vesencumab_HeavyChain1
  source 1..1359: mol_type = other RNA
gaggtgcagctggtggagagcggcggcggcctggtgcagcccggcggcagcctgagactgagctgcgccgccagcggcttcaccttcagcagctacgccatgagctgggtgagacaggcccccggcaagggcctggagtgggtgagccagatcagccccgccggcggctacaccaactacgccgacagcgtgaagggcagattcaccatcagcgccgacaccagcaagaacaccgcctacctgcagatgaacagcctgagagccgaggacaccgccgtgtactactgcgccagaggcgagctgccctactacagaatgagcaaggtgatggacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31501 - RNA, 642 nt, synthetic construct
  misc_feature 1..642: note = derived and/or modified sequence opt4 from Vesencumab_LightChain1
  source 1..642: mol_type = other RNA
gacatccagatgacccagagccccagcagcctgagcgccagcgtgggcgacagagtgaccatcacctgcagagccagccagtacttcagcagctacctggcctggtaccagcagaagcccggcaaggcccccaagctgctgatctacggcgccagcagcagagccagcggcgtgcccagcagattcagcggcagcggcagcggcaccgacttcaccctgaccatcagcagcctgcagcccgaggacttcgccacctactactgccagcagtacctgggcagcccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31502 - RNA, 1338 nt, synthetic construct
  misc_feature 1..1338: note = derived and/or modified sequence opt4 from Visilizumab_HeavyChain1
  source 1..1338: mol_type = other RNA
caggtgcagctggtgcagagcggcgccgaggtgaagaagcccggcgccagcgtgaaggtgagctgcaaggccagcggctacaccttcatcagctacaccatgcactgggtgagacaggcccccggccagggcctggagtggatgggctacatcaaccccagaagcggctacacccactacaaccagaagctgaaggacaaggccaccctgaccgccgacaagagcgccagcaccgcctacatggagctgagcagcctgagaagcgaggacaccgccgtgtactactgcgccagaagcgcctactacgactacgacggcttcgcctactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgccgccgcccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccagcaag

SEQ ID NO: 31503 - RNA, 639 nt, synthetic construct
  misc_feature 1..639: note = derived and/or modified sequence opt4 from Visilizumab_LightChain1
  source 1..639: mol_type = other RNA
gacatccagatgacccagagccccagcagcctgagcgccagcgtgggcgacagagtgaccatcacctgcagcgccagcagcagcgtgagctacatgaactggtaccagcagaagcccggcaaggcccccaagagactgatctacgacaccagcaagctggccagcggcgtgcccagcagattcagcggcagcggcagcggcaccgacttcaccctgaccatcagcagcctgcagcccgaggacttcgccacctactactgccagcagtggagcagcaacccccccaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31504 - RNA, 1353 nt, synthetic construct
  misc_feature 1..1353: note = derived and/or modified sequence opt4 from Volociximab_HeavyChain
  source 1..1353: mol_type = other RNA
caggtgcagctgaaggagagcggccccggcctggtggcccccagccagagcctgagcatcacctgcaccatcagcggcttcagcctgaccgactacggcgtgcactgggtgagacagccccccggcaagggcctggagtggctggtggtgatctggagcgacggcagcagcacctacaacagcgccctgaagagcagaatgaccatcagaaaggacaacagcaagagccaggtgttcctgatcatgaacagcctgcagaccgacgacagcgccatgtactactgcgccagacacggcacctactacggcatgaccaccaccggcgacgccctggactactggggccagggcaccagcgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31505 - RNA, 645 nt, synthetic construct
  misc_feature 1..645: note = derived and/or modified sequence opt4 from Volociximab_LightChain
  source 1..645: mol_type = other RNA
cagatcgtgctgacccagagccccgccatcatgagcgccagcctgggcgagagagtgaccatgacctgcaccgccagcagcagcgtgagcagcaactacctgcactggtaccagcagaagcccggcagcgcccccaacctgtggatctacagcaccagcaacctggccagcggcgtgcccgccagattcagcggcagcggcagcggcaccagctacagcctgaccatcagcagcatggaggccgaggacgccgccacctactactgccaccagtacctgagaagcccccccaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31506 - RNA, 1344 nt, synthetic construct
  misc_feature 1..1344: note = derived and/or modified sequence opt4 from Vorsetuzumab_HeavyChain1
  source 1..1344: mol_type = other RNA
caggtgcagctggtgcagagcggcgccgaggtgaagaagcccggcgccagcgtgaaggtgagctgcaaggccagcggctacaccttcaccaactacggcatgaactgggtgagacaggcccccggccagggcctgaagtggatgggctggatcaacacctacaccggcgagcccacctacgccgacgccttcaagggcagagtgaccatgaccagagacaccagcatcagcaccgcctacatggagctgagcagactgagaagcgacgacaccgccgtgtactactgcgccagagactacggcgactacggcatggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31507 - RNA, 654 nt, synthetic construct
  misc_feature 1..654: note = derived and/or modified sequence opt4 from Vorsetuzumab_LightChain1
  source 1..654: mol_type = other RNA
gacatcgtgatgacccagagccccgacagcctggccgtgagcctgggcgagagagccaccatcaactgcagagccagcaagagcgtgagcaccagcggctacagcttcatgcactggtaccagcagaagcccggccagccccccaagctgctgatctacctggccagcaacctggagagcggcgtgcccgacagattcagcggcagcggcagcggcaccgacttcaccctgaccatcagcagcctgcaggccgaggacgtggccgtgtactactgccagcacagcagagaggtgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31508 - RNA, 1344 nt, synthetic construct; identical to SEQ ID NO: 31506
  misc_feature 1..1344: note = derived and/or modified sequence opt4 from Vorsetuzumab_mafodotin_HeavyChain1
  source 1..1344: mol_type = other RNA

SEQ ID NO: 31509 - RNA, 654 nt, synthetic construct; identical to SEQ ID NO: 31507
  misc_feature 1..654: note = derived and/or modified sequence opt4 from Vorsetuzumab_mafodotin_LightChain1
  source 1..654: mol_type = other RNA

SEQ ID NO: 31510 - RNA, 1347 nt, synthetic construct; identical to SEQ ID NO: 30732
  misc_feature 1..1347: note = derived and/or modified sequence opt4 from Yttrium_(90Y)_clivatuzumab_tetraxetan_HeavyChain1
  source 1..1347: mol_type = other RNA

SEQ ID NO: 31511 - RNA, 645 nt, synthetic construct; identical to SEQ ID NO: 30733
  misc_feature 1..645: note = derived and/or modified sequence opt4 from Yttrium_(90Y)_clivatuzumab_tetraxetan_LightChain1
  source 1..645: mol_type = other RNA

SEQ ID NO: 31512 - RNA, 1338 nt, synthetic construct
  misc_feature 1..1338: note = derived and/or modified sequence opt4 from Yttrium_Y_90_epratuzumab_tetraxetan_HeavyChain1
  source 1..1338: mol_type = other RNA
caggtgcagctggtgcagagcggcgccgaggtgaagaagcccggcagcagcgtgaaggtgagctgcaaggccagcggctacaccttcaccagctactggctgcactgggtgagacaggcccccggccagggcctggagtggatcggctacatcaaccccagaaacgactacaccgagtacaaccagaacttcaaggacaaggccaccatcaccgccgacgagagcaccaacaccgcctacatggagctgagcagcctgagaagcgaggacaccgccttctacttctgcgccagaagagacatcaccaccttctactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31513 - RNA, 657 nt, synthetic construct
  misc_feature 1..657: note = derived and/or modified sequence opt4 from Yttrium_Y_90_epratuzumab_tetraxetan_LightChain1
  source 1..657: mol_type = other RNA
gacatccagctgacccagagccccagcagcctgagcgccagcgtgggcgacagagtgaccatgagctgcaagagcagccagagcgtgctgtacagcgccaaccacaagaactacctggcctggtaccagcagaagcccggcaaggcccccaagctgctgatctactgggccagcaccagagagagcggcgtgcccagcagattcagcggcagcggcagcggcaccgacttcaccttcaccatcagcagcctgcagcccgaggacatcgccacctactactgccaccagtacctgagcagctggaccttcggcggcggcaccaaggtgcagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31514 - RNA, 1326 nt, synthetic construct
  misc_feature 1..1326: note = derived and/or modified sequence opt4 from Yttrium_Y_90_epratuzumab_HeavyChain1
  source 1..1326: mol_type = other RNA
caggtgcagctggtgcagagcggcgccgaggtgaagaagcccggcagcagcgtgaaggtgagctgcaaggccagcggctacaccttcaccagctactggctgcactgggtgagacaggcccccggccagggcctggagtggatcggctacatcaaccccagaaacgactacaccgagtacaaccagaacttcaaggacaaggccaccatcaccgccgacgagagcaccaacaccgcctacgagctgagcagcctgagaagcgaggacaccgccttctacttctgcgccagaagagacatcaccaccttctactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgcacgaggccctgcacaaccactacacccagaagagcctgagcctgagccccggcaag

SEQ ID NO: 31515 - RNA, 654 nt, synthetic construct
  misc_feature 1..654: note = derived and/or modified sequence opt4 from Yttrium_Y_90_epratuzumab_LightChain1
  source 1..654: mol_type = other RNA
gacatccagctgacccagagccccagcagcctgagcgccagcgtgggcgacagagtgaccagctgcaagagcagccagagcgtgctgtacagcgccaaccacaagaactacctggcctggtaccagcagaagcccggcaaggcccccaagctgctgatctactgggccagcaccagagagagcggcgtgcccagcagattcagcggcagcggcagcggcaccgacttcaccttcaccatcagcagcctgcagcccgaggacatcgccacctactactgccaccagtacctgagcagctggaccttcggcggcggcaccaaggtgcagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31516 - RNA, 1365 nt, synthetic construct
  misc_feature 1..1365: note = derived and/or modified sequence opt4 from Zalutumumab_HeavyChain1
  source 1..1365: mol_type = other RNA
caggtgcagctggtggagagcggcggcggcgtggtgcagcccggcagaagcctgagactgagctgcgccgccagcggcttcaccttcagcacctacggcatgcactgggtgagacaggcccccggcaagggcctggagtgggtggccgtgatctgggacgacggcagctacaagtactacggcgacagcgtgaagggcagattcaccatcagcagagacaacagcaagaacaccctgtacctgcagatgaacagcctgagagccgaggacaccgccgtgtactactgcgccagagacggcatcaccatggtgagaggcgtgatgaaggactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31517 - RNA, 642 nt, synthetic construct
  misc_feature 1..642: note = derived and/or modified sequence opt4 from Zalutumumab_LightChain1
  source 1..642: mol_type = other RNA
gccatccagctgacccagagccccagcagcctgagcgccagcgtgggcgacagagtgaccatcacctgcagagccagccaggacatcagcagcgccctggtgtggtaccagcagaagcccggcaaggcccccaagctgctgatctacgacgccagcagcctggagagcggcgtgcccagcagattcagcggcagcgagagcggcaccgacttcaccctgaccatcagcagcctgcagcccgaggacttcgccacctactactgccagcagttcaacagctaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31518 - RNA, 1332 nt, synthetic construct
  misc_feature 1..1332: note = derived and/or modified sequence opt4 from Zanolimumab_H0_HeavyChain
  source 1..1332: mol_type = other RNA
caggtgcagctgcagcagtggggcgccggcctgctgaagcccagcgagaccctgagcctgacctgcgccgtgtacggcggcagcttcagcggctactactggagctggatcagacagccccccggcaagggcctggagtggatcggcgagatcaaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagagtgatcaactggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagctggaccgtgcccagcagcagcctgggcacccagacctacatctgcaacgtgaacttcatcaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtgtgggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31519 - RNA, 642 nt, synthetic construct
  misc_feature 1..642: note = derived and/or modified sequence opt4 from Zanolimumab_L0_LightChain
  source 1..642: mol_type = other RNA
gacatccagatgacccagagccccagcagcgtgagcgccagcgtgggcgacagagtgaccatcacctgcagagccagccaggacatcagcagctggctggccgtggtgtaccagcacaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcaggccaacagcttcccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagttcaacagaggcgagtgc

SEQ ID NO: 31520 - RNA, 1344 nt, synthetic construct; identical to SEQ ID NO: 31139
  misc_feature 1..1344: note = derived and/or modified sequence opt4 from Zatuximab_HeavyChain1
  source 1..1344: mol_type = other RNA

SEQ ID NO: 31521 - RNA, 657 nt, synthetic construct; identical to SEQ ID NO: 31140
  misc_feature 1..657: note = derived and/or modified sequence opt4 from Zatuximab_LightChain1
  source 1..657: mol_type = other RNA

SEQ ID NO: 31522 - RNA, 1356 nt, synthetic construct
  misc_feature 1..1356: note = derived and/or modified sequence opt4 from Actoxumab_HeavyChain
  source 1..1356: mol_type = other RNA
caggtgcagctggtggagagcggcggcggcgtggtgcagcccggcagaagcctgagactgagctgcgccgccagcggcttcagcttcagcaactacggcatgcactgggtgagacaggcccccggcaagggcctggagtgggtggccctgatctggtacgacggcagcaacgaggactacaccgacagcgtgaagggcagattcaccatcagcagagacaacagcaagaacaccctgtacctgcagatgaacagcctgagagccgaggacaccgccgtgtactactgcgccagatggggcatggtgagaggcgtgatcgacgtgttcgacatctggggccagggcaccgtggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31523 - RNA, 642 nt, synthetic construct
  misc_feature 1..642: note = derived and/or modified sequence opt4 from Actoxumab_LightChain
  source 1..642: mol_type = other RNA
gacatccagatgacccagagccccagcagcgtgagcgccagcgtgggcgacagagtgaccatcacctgcagagccagccagggcatcagcagctggctggcctggtaccagcacaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcaggccaacagcttcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31524 - RNA, 1326 nt, synthetic construct
  misc_feature 1..1326: note = derived and/or modified sequence opt4 from Andecaliximab_HeavyChain
  source 1..1326: mol_type = other RNA
caggtgcagctgcaggagagcggccccggcctggtgaagcccagcgagaccctgagcctgacctgcaccgtgagcggcttcagcctgctgagctacggcgtgcactgggtgagacagccccccggcaagggcctggagtggctgggcgtgatctggaccggcggcaccaccaactacaacagcgccctgatgagcagattcaccatcagcaaggacgacagcaagaacaccgtgtacctgaagatgaacagcctgaagaccgaggacaccgccatctactactgcgccagatactactacggcatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31525 - RNA, 642 nt, synthetic construct
  misc_feature 1..642: note = derived and/or modified sequence opt4 from Andecaliximab_LightChain
  source 1..642: mol_type = other RNA
gacatccagatgacccagagccccagcagcctgagcgccagcgtgggcgacagagtgaccatcacctgcaaggccagccaggacgtgagaaacaccgtggcctggtaccagcagaagcccggcaaggcccccaagctgctgatctacagcagcagctacagaaacaccggcgtgcccgacagattcagcggcagcggcagcggcaccgacttcaccctgaccatcagcagcctgcaggccgaggacgtggccgtgtactactgccagcagcactacatcaccccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31526 - RNA, 1353 nt, synthetic construct
  misc_feature 1..1353: note = derived and/or modified sequence opt4 from Aprutumab_HeavyChain
  source 1..1353: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtgagcgccatcagcggcagcggcaccagcacctactacgccgacagcgtgaagggcagattcaccatcagcagagacaacagcaagaacaccctgtacctgcagatgaacagcctgagagccgaggacaccgccgtgtactactgcgccagagtgagatacaactggaaccacggcgactggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31527 - RNA, 648 nt, synthetic construct
  misc_feature 1..648: note = derived and/or modified sequence opt4 from Aprutumab_LightChain
  source 1..648: mol_type = other RNA
cagagcgtgctgacccagccccccagcgccagcggcacccccggccagagagtgaccatcagctgcagcggcagcagcagcaacatcggcaacaactacgtgagctggtaccagcagctgcccggcaccgcccccaagctgctgatctacgagaactacaacagacccgccggcgtgcccgacagattcagcggcagcaagagcggcaccagcgccagcctggccatcagcggcctgagaagcgaggacgaggccgactactactgcagcagctgggacgacagcctgaactactgggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31528 - RNA, 1341 nt, synthetic construct
  misc_feature 1..1341: note = derived and/or modified sequence opt4 from Azintuxizumab_HeavyChain
  source 1..1341: mol_type = other RNA
gaggtgcagctggtggagagcggcggcggcctggtgcagcccggcggcagcctgagactgagctgcgccgccagcggcttcaccttcagcgactactacatggcctgggtgagacaggcccccggcaagggcctggagtgggtggccagcatcaactacgacggcagcagcacctactacgtggacagcgtgaagggcagattcaccatcagcagagacaacgccaagaacagcctgtacctgcagatgaacagcctgagagccgaggacaccgccgtgtactactgcgccagagacagaggctactacttcgactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31529 - RNA, 660 nt, synthetic construct
  misc_feature 1..660: note = derived and/or modified sequence opt4 from Azintuxizumab_LightChain
  source 1..660: mol_type = other RNA
gacgtggtgatgacccagacccccctgagcctgagcgtgacccccggccagcccgccagcatcagctgcagaagcagccagagcctggtgcacagcaacggcaacacctacctgcactggtacctgcagaagcccggccagagcccccagctgctgatctacaaggtgagcaacagattcagcggcgtgcccgacagattcagcggcagcggcagcggcaccgacttcaccctgaagatcagcagagtggaggccgaggacgtgggcgtgtacttctgcagccagagcacccacgtgccccccttcaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31530 - RNA, 366 nt, synthetic construct
  misc_feature 1..366: note = derived and/or modified sequence opt4 from Blinatumomab_HeavyChain1
  source 1..366: mol_type = other RNA
caggtgcagctgcagcagagcggcgccgagctggtgagacccggcagcagcgtgaagatcagctgcaaggccagcggctacgccttcagcagctactggatgaactgggtgaagcagagacccggccagggcctggagtggatcggccagatctggcccggcgacggcgacaccaactacaacggcaagttcaagggcaaggccaccctgaccgccgacgagagcagcagcaccgcctacatgcagctgagcagcctggccagcgaggacagcgccgtgtacttctgcgccagaagagagaccaccaccgtgggcagatactactacgccatggactactggggccagggcaccaccgtgaccgtg

SEQ ID NO: 31531 - RNA, 363 nt, synthetic construct
  misc_feature 1..363: note = derived and/or modified sequence opt4 from Blinatumomab_HeavyChain2
  source 1..363: mol_type = other RNA
gacatcaagctgcagcagagcggcgccgagctggccagacccggcgccagcgtgaagatgagctgcaagaccagcggctacaccttcaccagatacaccatgcactgggtgaagcagagacccggccagggcctggagtggatcggctacatcaaccccagcagaggctacaccaactacaaccagaagttcaaggacaaggccaccctgaccaccgacaagagcagcagcaccgcctacatgcagctgagcagcctgaccagcgaggacagcgccgtgtactactgcgccagatactacgacgaccactactgcctggactactggggccagggcaccaccctgaccgtgagcagcgtggag

SEQ ID NO: 31532 - RNA, 1494 nt, synthetic construct
  misc_feature 1..1494: note = derived and/or modified sequence opt4 from Blinatumomab_LightChain_HeavyChain_HeavyChain_LightChain
  source 1..1494: mol_type = other RNA
gacatccagctgacccagagccccgccagcctggccgtgagcctgggccagagagccaccatcagctgcaaggccagccagagcgtggactacgacggcgacagctacctgaactggtaccagcagatccccggccagccccccaagctgctgatctacgacgccagcaacctggtgagcggcatcccccccagattcagcggcagcggcagcggcaccgacttcaccctgaacatccaccccgtggagaaggtggacgccgccacctaccactgccagcagagcaccgaggacccctggaccttcggcggcggcaccaagctggagatcaagggcggcggcggcagcggcggcggcggcagcggcggcggcggcagccaggtgcagctgcagcagagcggcgccgagctggtgagacccggcagcagcgtgaagatcagctgcaaggccagcggctacgccttcagcagctactggatgaactgggtgaagcagagacccggccagggcctggagtggatcggccagatctggcccggcgacggcgacaccaactacaacggcaagttcaagggcaaggccaccctgaccgccgacgagagcagcagcaccgcctacatgcagctgagcagcctggccagcgaggacagcgccgtgtacttctgcgccagaagagagaccaccaccgtgggcagatactactacgccatggactactggggccagggcaccaccgtgaccgtgagcagcggcggcggcggcagcgacatcaagctgcagcagagcggcgccgagctggccagacccggcgccagcgtgaagatgagctgcaagaccagcggctacaccttcaccagatacaccatgcactgggtgaagcagagacccggccagggcctggagtggatcggctacatcaaccccagcagaggctacaccaactacaaccagaagttcaaggacaaggccaccctgaccaccgacaagagcagcagcaccgcctacatgcagctgagcagcctgaccagcgaggacagcgccgtgtactactgcgccagatactacgacgaccactactgcctggactactggggccagggcaccaccctgaccgtgagcagcgtggagggcggcagcggcggcagcggcggcagcggcggcagcggcggcgtggacgacatccagctgacccagagccccgccatcatgagcgccagccccggcgagaaggtgaccatgacctgcagagccagcagcagcgtgagctacatgaactggtaccagcagaagagcggcaccagccccaagagatggatctacgacaccagcaaggtggccagcggcgtgccctacagattcagcggcagcggcagcggcaccagctacagcctgaccatcagcagcatggaggccgaggacgccgccacctactactgccagcagtggagcagcaaccccctgaccttcggcgccggcaccaagctggagctgaag

SEQ ID NO: 31533 - RNA, 333 nt, synthetic construct
  misc_feature 1..333: note = derived and/or modified sequence opt4 from Blinatumomab_LightChain1
  source 1..333: mol_type = other RNA
gacatccagctgacccagagccccgccagcctggccgtgagcctgggccagagagccaccatcagctgcaaggccagccagagcgtggactacgacggcgacagctacctgaactggtaccagcagatccccggccagccccccaagctgctgatctacgacgccagcaacctggtgagcggcatcccccccagattcagcggcagcggcagcggcaccgacttcaccctgaacatccaccccgtggagaaggtggacgccgccacctaccactgccagcagagcaccgaggacccctggaccttcggcggcggcaccaagctggagatcaag

SEQ ID NO: 31534 - RNA, 324 nt, synthetic construct
  misc_feature 1..324: note = derived and/or modified sequence opt4 from Blinatumomab_LightChain2
  source 1..324: mol_type = other RNA
gtggacgacatccagctgacccagagccccgccatcatgagcgccagccccggcgagaaggtgaccatgacctgcagagccagcagcagcgtgagctacatgaactggtaccagcagaagagcggcaccagccccaagagatggatctacgacaccagcaaggtggccagcggcgtgccctacagattcagcggcagcggcagcggcaccagctacagcctgaccatcagcagcatggaggccgaggacgccgccacctactactgccagcagtggagcagcaaccccctgaccttcggcgccggcaccaagctggagctgaag

SEQ ID NO: 31535 - RNA, 1350 nt, synthetic construct
  misc_feature 1..1350: note = derived and/or modified sequence opt4 from Brazikumab_HeavyChain
  source 1..1350: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatctggtacgacggcagcaacgagtactacgccgacagcgtgaagggcagattcaccatcagcagagacaacagcaagaacaccctgtacctgcagatgaacagcctgagagccgaggacaccgccgtgtactactgcgccagagacagaggctacaccagcagctggtaccccgacgccttcgacatctggggccagggcaccatggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31536 - RNA, 651 nt, synthetic construct
  misc_feature 1..651: note = derived and/or modified sequence opt4 from Brazikumab_LightChain
  source 1..651: mol_type = other RNA
cagagcgtgctgacccagccccccagcgtgagcggcgcccccggccagagagtgaccatcagctgcaccggcagcagcagcaacaccggcgccggctacgacgtgcactggtaccagcaggtgcccggcaccgcccccaagctgctgatctacggcagcggcaacagacccagcggcgtgcccgacagattcagcggcagcaagagcggcaccagcgccagcctggccatcaccggcctgcaggccgaggacgaggccgactactactgccagagctacgacagcagcctgagcggctgggtgttcggcggcggcaccagactgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31537 - RNA, 363 nt, synthetic construct
  misc_feature 1..363: note = derived and/or modified sequence opt4 from Brolucizumab_HeavyChain
  source 1..363: mol_type = other RNA
agcgaggtgcagctggtggagagcggcggcggcctggtgcagcccggcggcagcctgagactgagctgcaccgccagcggcttcagcctgaccgactactactacatgacctgggtgagacaggcccccggcaagggcctggagtgggtgggcttcatcgaccccgacgacgacccctactacgccacctgggccaagggcagattcaccatcagcagagacaacagcaagaacaccctgtacctgcagatgaacagcctgagagccgaggacaccgccgtgtactactgcgccggcggcgaccacaacagcggctggggcctggacatctggggccagggcaccctggtgaccgtgagcagc

SEQ ID NO: 31538 - RNA, 333 nt, synthetic construct
  misc_feature 1..333: note = derived and/or modified sequence opt4 from Brolucizumab_LightChain
  source 1..333: mol_type = other RNA
atggagatcgtgatgacccagagccccagcaccctgagcgccagcgtgggcgacagagtgatcatcacctgccaggccagcgagatcatccacagctggctggcctggtaccagcagaagcccggcaaggcccccaagctgctgatctacctggccagcaccctggccagcggcgtgcccagcagattcagcggcagcggcagcggcgccgagttcaccctgaccatcagcagcctgcagcccgacgacttcgccacctactactgccagaacgtgtacctggccagcaccaacggcgccaacttcggccagggcaccaagctgaccgtgctg

SEQ ID NO: 31539 - RNA, 1347 nt, synthetic construct
  misc_feature 1..1347: note = derived and/or modified sequence opt4 from Cabiralizumab_HeavyChain
  source 1..1347: mol_type = other RNA
caggtgcagctggtgcagagcggcgccgaggtgaagaagcccggcagcagcgtgaaggtgagctgcaaggccagcggctacaccttcaccgacaactacatgatctgggtgagacaggcccccggccagggcctggagtggatgggcgacatcaacccctacaacggcggcaccaccttcaaccagaagttcaagggcagagtgaccatcaccgccgacaagagcaccagcaccgcctacatggagctgagcagcctgagaagcgaggacaccgccgtgtactactgcgccagagagagcccctacttcagcaacctgtacgtgatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31540 - RNA, 654 nt, synthetic construct
  misc_feature 1..654: note = derived and/or modified sequence opt4 from Cabiralizumab_LightChain
  source 1..654: mol_type = other RNA
gagatcgtgctgacccagagccccgccaccctgagcctgagccccggcgagagagccaccctgagctgcaaggccagccagagcgtggactacgacggcgacaactacatgaactggtaccagcagaagcccggccaggcccccagactgctgatctacgccgccagcaacctggagagcggcatccccgccagattcagcggcagcggcagcggcaccgacttcaccctgaccatcagcagcctggagcccgaggacttcgccgtgtactactgccacctgagcaacgaggacctgagcaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31541 - RNA, 1329 nt, synthetic construct
  misc_feature 1..1329: note = derived and/or modified sequence opt4 from Camrelizumab_HeavyChain
  source 1..1329: mol_type = other RNA
gaggtgcagctggtggagagcggcggcggcctggtgcagcccggcggcagcctgagactgagctgcgccgccagcggcttcaccttcagcagctacatgatgagctgggtgagacaggcccccggcaagggcctggagtgggtggccaccatcagcggcggcggcgccaacacctactaccccgacagcgtgaagggcagattcaccatcagcagagacaacgccaagaacagcctgtacctgcagatgaacagcctgagagccgaggacaccgccgtgtactactgcgccagacagctgtactacttcgactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31542 - RNA, 642 nt, synthetic construct
  misc_feature 1..642: note = derived and/or modified sequence opt4 from Camrelizumab_LightChain
  source 1..642: mol_type = other RNA
gacatccagatgacccagagccccagcagcctgagcgccagcgtgggcgacagagtgaccatcacctgcctggccagccagaccatcggcacctggctgacctggtaccagcagaagcccggcaaggcccccaagctgctgatctacaccgccaccagcctggccgacggcgtgcccagcagattcagcggcagcggcagcggcaccgacttcaccctgaccatcagcagcctgcagcccgaggacttcgccacctactactgccagcaggtgtacagcatcccctggaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31543 - RNA, 777 nt, synthetic construct; identical to SEQ ID NO: 30710
  misc_feature 1..777: note = derived and/or modified sequence opt4 from Caplacizumab_HeavyChain
  source 1..777: mol_type = other RNA

SEQ ID NO: 31544 - RNA, 657 nt, synthetic construct
  misc_feature 1..657: note = derived and/or modified sequence opt4 from Citatuzumab_bogatox_HeavyChain
  source 1..657: mol_type = other RNA
gaggtgcagctggtgcagagcggccccggcctggtgcagcccggcggcagcgtgagaatcagctgcgccgccagcggctacaccttcaccaactacggcatgaactgggtgaagcaggcccccggcaagggcctggagtggatgggctggatcaacacctacaccggcgagagcacctacgccgacagcttcaagggcagattcaccttcagcctggacaccagcgccagcgccgcctacctgcagatcaacagcctgagagccgaggacaccgccgtgtactactgcgccagattcgccatcaagggcgactactggggccagggcaccctgctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31545 - RNA, 1356 nt, synthetic construct
  misc_feature 1..1356: note = derived and/or modified sequence opt4 from Cosfroviximab_HeavyChain
  source 1..1356: mol_type = other RNA
gacgtgaagctgctggagagcggcggcggcctggtgcagcccggcggcagcctgaagctgagctgcgccgccagcggcttcagcctgagcaccagcggcgtgggcgtgggctggttcagacagcccagcggcaagggcctggagtggctggccctgatctggtgggacgacgacaagtactacaaccccagcctgaagagccagctgagcatcagcaaggacttcagcagaaaccaggtgttcctgaagatcagcaacgtggacatcgccgacaccgccacctactactgcgccagaagagaccccttcggctacgacaacgccatgggctactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31546 - RNA, 639 nt, synthetic construct
  misc_feature 1..639: note = derived and/or modified sequence opt4 from Cosfroviximab_LightChain
  source 1..639: mol_type = other RNA
gacatcgtgatgacccagagccccctgagcctgagcaccagcgtgggcgacagagtgagcctgacctgcaaggccagccagaacgtgggcaccgccgtggcctggtaccagcagaagcccggccagagccccaagctgctgatctacagcgccagcaacagatacaccggcgtgcccgacagattcaccggcagcggcagcggcaccgacttcaccctgaccatcagcaacatgcagagcgaggacctggccgactacttctgccagcagtacagcagctaccccctgaccttcggcgccggcaccaagctggagctgagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31547 - RNA, 1344 nt, synthetic construct
  misc_feature 1..1344: note = derived and/or modified sequence opt4 from Crizanlizumab_HeavyChain
  source 1..1344: mol_type = other RNA
caggtgcagctggtgcagagcggcgccgaggtgaagaagcccggcgccagcgtgaaggtgagctgcaaggtgagcggctacaccttcaccagctacgacatcaactgggtgagacaggcccccggcaagggcctggagtggatgggctggatctaccccggcgacggcagcatcaagtacaacgagaagttcaagggcagagtgaccatgaccgtggacaagagcaccgacaccgcctacatggagctgagcagcctgagaagcgaggacaccgccgtgtactactgcgccagaagaggcgagtacggcaactacgagggcgccatggactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgaccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcgccgtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31548 - RNA, 654 nt, synthetic construct
  misc_feature 1..654: note = derived and/or modified sequence opt4 from Crizanlizumab_LightChain
  source 1..654: mol_type = other RNA
gacatccagatgacccagagccccagcagcctgagcgccagcgtgggcgacagagtgaccatcacctgcaaggccagccagagcgtggactacgacggccacagctacatgaactggtaccagcagaagcccggcaaggcccccaagctgctgatctacgccgccagcaacctggagagcggcgtgcccagcagattcagcggcagcggcagcggcaccgacttcaccctgaccatcagcagcctgcagcccgaggacttcgccacctactactgccagcagagcgacgagaaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31549 - RNA, 1365 nt, synthetic construct
  misc_feature 1..1365: note = derived and/or modified sequence opt4 from Crotedumab_HeavyChain
  source 1..1365: mol_type = other RNA
gaggtgcagctggtggagagcggcggcggcctggtgcagcccggcggcagcctgagactgagctgcgccgccagcggcttcaccttcagcaactacctgatgaactgggtgagacaggcccccggcaagggcctggagtggctggccaacatccaggaggacggcatcgagaagtactacgtggacagcgtgaagggcagattcaccatcagcagagacaacgccaagaacagcctgtacctgcagatgaacagcctgagagccgaggacaccgccgtgtactactgcgccagagagcccagccactacgacatcctgaccggctacgactactactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31550 - RNA, 642 nt, synthetic construct
  misc_feature 1..642: note = derived and/or modified sequence opt4 from Crotedumab_LightChain
  source 1..642: mol_type = other RNA
gacatccagatgacccagagccccagcagcctgagcgccagcgtgggcgacagagtgaccatcacctgcagagccagccagggcatcagaaacgacctgggctggtaccagcagaagcccggcaaggcccccaagagactgatctacgccgccagcagcctgcagagcggcgtgcccagcagattcagcggcagcggcagcggcaccgagttcatcctgaccgtgagcagcctgcagcccgaggacttcgccacctactactgcctgcagtacaacagcaaccccttcaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31551 - RNA, 1356 nt, synthetic construct
  misc_feature 1..1356: note = derived and/or modified sequence opt4 from Dezamizumab_HeavyChain
  source 1..1356: mol_type = other RNA
caggtgcagctggtgcagagcggcgccgaggtgaagaagcccggcagcagcgtgaaggtgagctgcaaggccagcggcttcaccttcgccacctacaacatgcactgggtgagacaggcccccggccagggcctggagtggatgggctacatctaccccggcgacggcaacgccaactacaaccagcagttcaagggcagagtgaccatcaccgccgacaagagcaccagcaccgcctacatggagctgagcagcctgagaagcgaggacaccgccgtgtactactgcgccagaggcgacttcgactacgacggcggctactacttcgacagctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31552 - RNA, 642 nt, synthetic construct
  misc_feature 1..642: note = derived and/or modified sequence opt4 from Dezamizumab_LightChain
  source 1..642: mol_type = other RNA
gacatccagatgacccagagccccagcagcctgagcgccagcgtgggcgacagagtgaccatcacctgcagagccagcgagaacatctacagctacctggcctggtaccagcagaagcccggcaaggcccccaagctgctgatccacaacgccaagaccctggccgagggcgtgcccagcagattcagcggcagcggcagcggcaccgacttcaccctgaccatcagcagcctgcagcccgaggacttcgccacctactactgccagcaccactacggcgcccccctgaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31553 - RNA, 1506 nt, synthetic construct
  misc_feature 1..1506: note = derived and/or modified sequence opt4 from Duvortuxizumab_Chain1_scFv
  source 1..1506: mol_type = other RNA
gagaacgtgctgacccagagccccgccaccctgagcgtgacccccggcgagaaggccaccatcacctgcagagccagccagagcgtgagctacatgcactggtaccagcagaagcccggccaggcccccagactgctgatctacgacgccagcaacagagccagcggcgtgcccagcagattcagcggcagcggcagcggcaccgaccacaccctgaccatcagcagcctggaggccgaggacgccgccacctactactgcttccagggcagcgtgtaccccttcaccttcggccagggcaccaagctggagatcaagggcggcggcagcggcggcggcggcgaggtgcagctggtggagagcggcggcggcctggtgcagcccggcggcagcctgagactgagctgcgccgccagcggcttcaccttcagcacctacgccatgaactgggtgagacaggcccccggcaagggcctggagtgggtgggcagaatcagaagcaagtacaacaactacgccacctactacgccgacagcgtgaagggcagattcaccatcagcagagacgacagcaagaacagcctgtacctgcagatgaacagcctgaagaccgaggacaccgccgtgtactactgcgtgagacacggcaacttcggcaacagctacgtgagctggttcgcctactggggccagggcaccctggtgaccgtgagcagcgccagcaccaagggcgaggtggccgcctgcgagaaggaggtggccgccctggagaaggaggtggccgccctggagaaggaggtggccgccctggagaagggcggcggcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgtggtgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31554 - RNA, 813 nt, synthetic construct
  misc_feature 1..813: note = derived and/or modified sequence opt4 from Duvortuxizumab_Chain2_scFv
  source 1..813: mol_type = other RNA
caggccgtggtgacccaggagcccagcctgaccgtgagccccggcggcaccgtgaccctgacctgcagaagcagcaccggcgccgtgaccaccagcaactacgccaactgggtgcagcagaagcccggccaggcccccagaggcctgatcggcggcaccaacaagagagccccctggacccccgccagattcagcggcagcctgctgggcggcaaggccgccctgaccatcaccggcgcccaggccgaggacgaggccgactactactgcgccctgtggtacagcaacctgtgggtgttcggcggcggcaccaagctgaccgtgctgggcggcggcggcagcggcggcggcggccaggtgaccctgagagagagcggccccgccctggtgaagcccacccagaccctgaccctgacctgcaccttcagcggcttcagcctgagcaccagcggcatgggcgtgggctggatcagacagccccccggcaaggccctggagtggctggcccacatctggtgggacgacgacaagagatacaaccccgccctgaagagcagactgaccatcagcaaggacaccagcaagaaccaggtgttcctgaccatgaccaacatggaccccgtggacaccgccacctactactgcgccagaatggagctgtggagctactacttcgactactggggccagggcaccaccgtgaccgtgagcagcgccagcaccaagggcaaggtggccgcctgcaaggagaaggtggccgccctgaaggagaaggtggccgccctgaaggagaaggtggccgccctgaaggag

SEQ ID NO: 31555 - RNA, 681 nt, synthetic construct
  misc_feature 1..681: note = derived and/or modified sequence opt4 from Duvortuxizumab_Chain3_h-CH2-CH3
  source 1..681: mol_type = other RNA
gacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgagctgcgccgtgaagggcttctaccccagcgacatcgccgtggagtgggagagcaacggccagcccgagaacaactacaagaccaccccccccgtgctggacagcgacggcagcttcttcctggtgagcaagctgaccgtggacaagagcagatggcagcagggcaacgtgttcagctgcagcgtgatgcacgaggccctgcacaacagatacacccagaagagcctgagcctgagccccggcaag

SEQ ID NO: 31556 - RNA, 360 nt, synthetic construct
  misc_feature 1..360: note = derived and/or modified sequence opt4 from Efungumab_HeavyChain
  source 1..360: mol_type = other RNA
atggccgaggtgcagctggtggagagcggcgccgaggtgaagaagcccggcgagagcctgagaatcagctgcaagggcagcggctgcatcatcagcagctactggatcagctgggtgagacagatgcccggcaagggcctggagtggatgggcaagatcgaccccggcgacagctacatcaactacagccccagcttccagggccacgtgaccatcagcgccgacaagagcatcaacaccgcctacctgcagtggaacagcctgaaggccagcgacaccgccatgtactactgcgccagaggcggcagagacttcggcgacagcttcgactactggggccagggcaccctggtgaccgtg

SEQ ID NO: 31557 - RNA, 750 nt, synthetic construct
  misc_feature 1..750: note = derived and/or modified sequence opt4 from Efungumab_HeavyChain_LightChain
  source 1..750: mol_type = other RNA
atggccgaggtgcagctggtggagagcggcgccgaggtgaagaagcccggcgagagcctgagaatcagctgcaagggcagcggctgcatcatcagcagctactggatcagctgggtgagacagatgcccggcaagggcctggagtggatgggcaagatcgaccccggcgacagctacatcaactacagccccagcttccagggccacgtgaccatcagcgccgacaagagcatcaacaccgcctacctgcagtggaacagcctgaaggccagcgacaccgccatgtactactgcgccagaggcggcagagacttcggcgacagcttcgactactggggccagggcaccctggtgaccgtgagcagcggcggcggcggcagcggcggcggcggcagcggcggcggcggcagcgacgtggtgatgacccagagccccagcttcctgagcgccttcgtgggcgacagaatcaccatcacctgcagagccagcagcggcatcagcagatacctggcctggtaccagcaggcccccggcaaggcccccaagctgctgatctacgccgccagcaccctgcagaccggcgtgcccagcagattcagcggcagcggcagcggcaccgagttcaccctgaccatcaacagcctgcagcccgaggacttcgccacctactactgccagcacctgaacagctaccccctgaccttcggcggcggcaccaaggtggacatcaagagagccgccgccctggag

SEQ ID NO: 31558 - RNA, 339 nt, synthetic construct
  misc_feature 1..339: note = derived and/or modified sequence opt4 from Efungumab_LightChain
  source 1..339: mol_type = other RNA
gacgtggtgatgacccagagccccagcttcctgagcgccttcgtgggcgacagaatcaccatcacctgcagagccagcagcggcatcagcagatacctggcctggtaccagcaggcccccggcaaggcccccaagctgctgatctacgccgccagcaccctgcagaccggcgtgcccagcagattcagcggcagcggcagcggcaccgagttcaccctgaccatcaacagcctgcagcccgaggacttcgccacctactactgccagcacctgaacagctaccccctgaccttcggcggcggcaccaaggtggacatcaagagagccgccgccctggag

SEQ ID NO: 31559 - RNA, 1350 nt, synthetic construct
  misc_feature 1..1350: note = derived and/or modified sequence opt4 from Elezanumab_HeavyChain
  source 1..1350: mol_type = other RNA
gaggtgcagctggtgcagagcggcgccgaggtgaagaagcccggcgccagcgtgaaggtgagctgcaaggccagcggctacaccttcaccagccacggcatcagctgggtgagacaggcccccggccagggcctggactggatgggctggatcagcccctacagcggcaacaccaactacgcccagaagctgcagggcagagtgaccatgaccaccgacaccagcaccagcaccgcctacatggagctgagcagcctgagaagcgaggacaccgccgtgtactactgcgccagagtgggcagcggcccctactactacatggacgtgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggaccagctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgctgcacgaggccctgcacaaccactacacccagaagagcctgagcctgagccccggcaag

SEQ ID NO: 31560 - RNA, 645 nt, synthetic construct
  misc_feature 1..645: note = derived and/or modified sequence opt4 from Elezanumab_LightChain
  source 1..645: mol_type = other RNA
cagagcgccctgacccagcccagaagcgtgagcggcagccccggccagagcgtgaccatcagctgcaccggcaccagcagcagcgtgggcgacagcatctacgtgagctggtaccagcagcaccccggcaaggcccccaagctgatgctgtacgacgtgaccaagagacccagcggcgtgcccgacagattcagcggcagcaagagcggcaacaccgccagcctgaccatcagcggcctgcaggccgaggacgaggccgactactactgctacagctacgccggcaccgacaccctgttcggcggcggcaccaaggtgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31561 - RNA, 1359 nt, synthetic construct
  misc_feature 1..1359: note = derived and/or modified sequence opt4 from Emapalumab_HeavyChain
  source 1..1359: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtgagcgccatcagcggcagcggcggcagcacctactacgccgacagcgtgaagggcagattcaccatcagcagagacaacagcaagaacaccctgtacctgcagatgaacagcctgagagccgaggacaccgccgtgtactactgcgccaaggacggcagcagcggctggtacgtgccccactggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31562 - RNA, 651 nt, synthetic construct
  misc_feature 1..651: note = derived and/or modified sequence opt4 from Emapalumab_LightChain
  source 1..651: mol_type = other RNA
aacttcatgctgacccagccccacagcgtgagcgagagccccggcaagaccgtgaccatcagctgcaccagaagcagcggcagcatcgccagcaactacgtgcagtggtaccagcagagacccggcagcagccccaccaccgtgatctacgaggacaaccagagacccagcggcgtgcccgacagattcagcggcagcatcgacagcagcagcaacagcgccagcctgaccatcagcggcctgaagaccgaggacgaggccgactactactgccagagctacgacggcagcaacagatggatgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31563 - RNA, 1341 nt, synthetic construct
  misc_feature 1..1341: note = derived and/or modified sequence opt4 from Enoblituzumab_HeavyChain
  source 1..1341: mol_type = other RNA
caggtggagctggtggagagcggcggcggcctggtgcagcccggcggcagcctgagactgagctgcgccgccagcggcttcaccttcaccagctactggatgagctgggtgagacaggcccccggcaagggcctggagctggtgagcagcatcaccagctacggcagcttcacctactacgccgacagcgtgaagggcagattcaccatcagcagagacaacagcaagaacaccctgtacctgcagatgaacagcctgagagccgaggacaccgccgtgtactactgcgccagaaacatgtacacccacttcgacagctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31564 - RNA, 648 nt, synthetic construct
  misc_feature 1..648: note = derived and/or modified sequence opt4 from Enoblituzumab_LightChain
  source 1..648: mol_type = other RNA
gacatcgtgctgacccagccccccagcgtgagcggcgcccccggccagagagtgaccatcagctgcagcggcagcagcagcaacatcggcagcaacagcgtgagctggtaccagcagctgcccggcaccgcccccaagctgctgatctacgacaacagcaagagacccagcggcgtgcccgacagattcagcggcagcaagagcggcaccagcgccagcctggccatcaccggcctgcagagcgaggacgaggccgactactactgccagagcagagacacctacggctactactgggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaagggcgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31565 - RNA, 1323 nt, synthetic construct
  misc_feature 1..1323: note = derived and/or modified sequence opt4 from Eptinezumab_HeavyChain
  source 1..1323: mol_type = other RNA
gaggtgcagctggtggagagcggcggcggcctggtgcagcccggcggcagcctgagactgagctgcgccgtgagcggcatcgacctgagcggctactacatgaactgggtgagacaggcccccggcaagggcctggagtgggtgggcgtgatcggcatcaacggcgccacctactacgccagctgggccaagggcagattcaccatcagcagagacaacagcaagaccaccgtgtacctgcagatgaacagcctgagagccgaggacaccgccgtgtacttctgcgccagaggcgacatctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacgccagagtggagcccaagagctgcgacaagacccacacctgccccccctgccccgcccccgagctgctgggcggccccagcgtgaccctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31566 - RNA, 657 nt, synthetic construct
  misc_feature 1..657: note = derived and/or modified sequence opt4 from Eptinezumab_LightChain
  source 1..657: mol_type = other RNA
caggtgctgacccagagccccagcagcctgagcgccagcgtgggcgacagagtgaccatcaactgccaggccagccagagcgtgtaccacaacacctacctggcctggtaccagcagaagcccggcaaggtgcccaagcagctgatctacgacgccagcaccctggccagcggcgtgcccagcagattcagcggcagcggcagcggcaccgacttcaccctgaccatcagcagcctgcagcccgaggacgtggccacctactactgcctgggcagctacgactgcaccaacggcgactgcttcgtgttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31567 - RNA, 1368 nt, synthetic construct
  misc_feature 1..1368: note = derived and/or modified sequence opt4 from Erenumab_HeavyChain
  source 1..1368: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagcttcgacggcagcatcaagtacagcgtggacagcgtgaagggcagattcaccatcagcagagacaacagcaagaacaccctgttcctgcagatgaacagcctgagagccgaggacaccgccgtgtactactgcgccagagacagactgaactactacgacagcagcggctactaccactacaagtactacggcatggccgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31568 - RNA, 648 nt, synthetic construct
  misc_feature 1..648: note = derived and/or modified sequence opt4 from Erenumab_LightChain
  source 1..648: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaacaacaagagacccagcggcatccccgacagattcagcggcagcaagagcggcaccagcaccaccctgggcatcaccggcctgcagaccggcgacgaggccgactactactgcggcacctgggacagcagactgagcgccgtggtgttcggcggcggcaccaagctgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31569 - RNA, 1344 nt, synthetic construct
  misc_feature 1..1344: note = derived and/or modified sequence opt4 from Fremanezumab_HeavyChain
  source 1..1344: mol_type = other RNA
gaggtgcagctggtggagagcggcggcggcctggtgcagcccggcggcagcctgagactgagctgcgccgccagcggcttcaccttcagcaactactggatcagctgggtgagacaggcccccggcaagggcctggagtgggtggccgagatcagaagcgagagcgacgccagcgccacccactacgccgaggccgtgaagggcagattcaccatcagcagagacaacgccaagaacagcctgtacctgcagatgaacagcctgagagccgaggacaccgccgtgtactactgcctggcctacttcgactacggcctggccatccagaactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31570 - RNA, 642 nt, synthetic construct
  misc_feature 1..642: note = derived and/or modified sequence opt4 from Fremanezumab_LightChain
  source 1..642: mol_type = other RNA
gagatcgtgctgacccagagccccgccaccctgagcctgagccccggcgagagagccaccctgagctgcaaggccagcaagagagtgaccacctacgtgagctggtaccagcagaagcccggccaggcccccagactgctgatctacggcgccagcaacagatacctgggcatccccgccagattcagcggcagcggcagcggcaccgacttcaccctgaccatcagcagcctggagcccgaggacttcgccgtgtactactgcagccagagctacaactacccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31571 - RNA, 1371 nt, synthetic construct
  misc_feature 1..1371: note = derived and/or modified sequence opt4 from Frunevetmab_HeavyChain
  source 1..1371: mol_type = other RNA
caggtgcagctggtggagagcggcgccgagctggtgcagcccggcgagagcctgagactgacctgcgccgccagcggcttcagcctgaccaacaacaacgtgaactgggtgagacaggcccccggcaagggcctggagtggatgggcggcgtgtgggccggcggcgccaccgactacaacagcgccctgaagagcagactgaccatcaccagagacaccagcaagaacaccgtgttcctgcagatgcacagcctgcagagcgaggacaccgccacctactactgcgccagagacggcggctacagcagcagcaccctgtacgccatggacgcctggggccagggcaccaccgtgaccgtgagcgccgccagcaccaccgcccccagcgtgttccccctggcccccagctgcggcaccaccagcggcgccaccgtggccctggcctgcctggtgctgggctacttccccgagcccgtgaccgtgagctggaacagcggcgccctgaccagcggcgtgcacaccttccccgccgtgctgcaggccagcggcctgtacagcctgagcagcatggtgaccgtgcccagcagcagatggctgagcgacaccttcacctgcaacgtggcccacccccccagcaacaccaaggtggacaagaccgtgagaaagaccgaccacccccccggccccaagccctgcgactgccccaagtgccccccccccgagatgctgggcggccccagcatcttcatcttcccccccaagcccaaggacaccctgagcatcagcagaacccccgaggtgacctgcctggtggtggacctgggccccgacgacagcgacgtgcagatcacctggttcgtggacaacacccaggtgtacaccgccaagaccagccccagagaggagcagttcaacagcacctacagagtggtgagcgtgctgcccatcctgcaccaggactggctgaagggcaaggagttcaagtgcaaggtgaacagcaagagcctgcccagccccatcgagagaaccatcagcaaggccaagggccagccccacgagccccaggtgtacgtgctgccccccgcccaggaggagctgagcagaaacaaggtgagcgtgacctgcctgatcaagagcttccacccccccgacatcgccgtggagtgggagatcaccggccagcccgagcccgagaacaactacagaaccacccccccccagctggacagcgacggcacctacttcgtgtacagcaagctgagcgtggacagaagccactggcagagaggcaacacctacacctgcagcgtgagccacgaggccctgcacagccaccacacccagaagagcctgacccagagccccggcaag

SEQ ID NO: 31572 - RNA, 651 nt, synthetic construct
  misc_feature 1..651: note = derived and/or modified sequence opt4 from Frunevetmab_LightChain
  source 1..651: mol_type = other RNA
gacatcgagatgacccagagccccctgagcctgagcgtgacccccggcgagagcgtgagcatcagctgcagagccagcgaggacatctacaacgccctggcctggtacctgcagaagcccggcagaagccccagactgctgatctacaacaccgacaccctgcacaccggcgtgcccgacagattcagcggcagcggcagcggcaccgacttcaccctgaagatcagcagagtgcagaccgaggacgtgggcgtgtacttctgccagcactacttccactaccccagaaccttcggccagggcaccaagctggagctgaagagaagcgacgcccagcccagcgtgttcctgttccagcccagcctggacgagctgcacaccggcagcgccagcatcgtgtgcatcctgaacgacttctaccccaaggaggtgaacgtgaagtggaaggtggacggcgtggtgcagaacaagggcatccaggagagcaccaccgagcagaacagcaaggacagcacctacagcctgagcagcaccctgaccatgagcagcaccgagtaccagagccacgagaagttcagctgcgaggtgacccacaagagcctggccagcaccctggtgaagagcttcaacagaagcgagtgccagagagag

SEQ ID NO: 31573 - RNA, 1341 nt, synthetic construct
  misc_feature 1..1341: note = derived and/or modified sequence opt4 from Gatipotuzumab_HeavyChain
  source 1..1341: mol_type = other RNA
gaggtgcagctggtggagagcggcggcggcctggtgcagcccggcggcagcatgagactgagctgcgtggccagcggcttccccttcagcaactactggatgaactgggtgagacaggcccccggcaagggcctggagtgggtgggcgagatcagactgaagagcaacaactacaccacccactacgccgagagcgtgaagggcagattcaccatcagcagagacgacagcaagaacagcctgtacctgcagatgaacagcctgaagaccgaggacaccgccgtgtactactgcaccagacactactacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 31574 - RNA, 657 nt, synthetic construct
  misc_feature 1..657: note = derived and/or modified sequence opt4 from Gatipotuzumab_LightChain
  source 1..657: mol_type = other RNA
gacatcgtgatgacccagagccccctgagcaaccccgtgacccccggcgagcccgccagcatcagctgcagaagcagcaagagcctgctgcacagcaacggcatcacctacttcttctggtacctgcagaagcccggccagagcccccagctgctgatctaccagatgagcaacctggccagcggcgtgcccgacagattcagcggcagcggcagcggcaccgacttcaccctgagaatcagcagagtggaggccgaggacgtgggcgtgtactactgcgcccagaacctggagctgccccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31575 - RNA, 1365 nt, synthetic construct
  misc_feature 1..1365: note = derived and/or modified sequence opt4 from Gedivumab_HeavyChain
  source 1..1365: mol_type = other RNA
gaggtgcagctggtggagagcggcggcggcgtggtgcagcccggcaagagcctgagactgagctgcgccgccagcggcctgaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31576 - RNA, 648 nt, synthetic construct
  misc_feature 1..648: note = derived and/or modified sequence opt4 from Gedivumab_LightChain
  source 1..648: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactggccccccagactgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31577 - RNA, 1329 nt, synthetic construct
  misc_feature 1..1329: note = derived and/or modified sequence opt4 from Gemetuzumab_HeavyChain
  source 1..1329: mol_type = other RNA
gaggtgcagctggtgcagagcggcgccgaggtgaagaagcccggcagcagcgtgaaggtgagctgcaaggccagcggctacaccatcaccgacagcaacatccactgggtgagacaggcccccggccagagcctggagtggatcggctacatctacccctacaacggcggcaccgactacaaccagaagttcaagaacagagccaccctgaccgtggacaaccccaccaacaccgcctacatggagctgagcagcctgagaagcgaggacaccgccttctactactgcgtgaacggcaacccctggctggcctactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31578 - RNA, 654 nt, synthetic construct
  misc_feature 1..654: note = derived and/or modified sequence opt4 from Gemetuzumab_LightChain
  source 1..654: mol_type = other RNA
gacatccagctgacccagagccccagcaccctgagcgccagcgtgggcgacagagtgaccatcacctgcagagccagcgagagcctggacaactacggcatcagattcctgacctggttccagcagaagcccggcaaggcccccaagctgctgatgtacgccgccagcaaccagggcagcggcgtgcccagcagattcagcggcagcggcagcggcaccgagttcaccctgaccatcagcagcctgcagcccgacgacttcgccacctactactgccagcagaccaaggaggtgccctggagcttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31579 - RNA, 1365 nt, synthetic construct
  misc_feature 1..1365: note = derived and/or modified sequence opt4 from Gilvetmab_HeavyChain
  source 1..1365: mol_type = other RNA
gaggtgcagctggtgcagagcggcggcgacctggtgaagcccggcggcagcgtgagactgagctgcgtggccagcggcttcaacatcaagaacacctacatgcactgggtgagacaggcccccggcaagggcctgcagtggatcggcagaatcgcccccgccaacgtggacaccaagtacgcccccaagttccagggcaaggccaccatcagcgccgacaccgccaagaacaccgcctacatgcagctgaacagcctgagagccgaggacaccgccgtgtactactgcgtgctgatctactacgactacgacggcgacatcgacgtgtggggccagggcaccctggtgaccgtgagcagcgccagcaccaccgcccccagcgtgttccccctggcccccagctgcggcagcaccagcggcagcaccgtggccctggcctgcctggtgagcggctacttccccgagcccgtgaccgtgagctggaacagcggcagcctgaccagcggcgtgcacaccttccccagcgtgctgcagagcagcggcctgtacagcctgagcagcatggtgaccgtgcccagcagcagatggcccagcgagaccttcacctgcaacgtggcccaccccgccagcaagaccaaggtggacaagcccgtgcccaagagagagaacggcagagtgcccagaccccccgactgccccaagtgccccgcccccgagatgctgggcggccccagcgtgttcatcttcccccccaagcccaaggacaccctgctgatcgccagaacccccgaggtgacctgcgtggtggtggccctggaccccgaggaccccgaggtgcagatcagctggttcgtggacggcaagcagatgcagaccgccaagacccagcccagagaggagcagttcgccggcacctacagagtggtgagcgtgctgcccatcggccaccaggactggctgaagggcaagcagttcacctgcaaggtgaacaacaaggccctgcccagccccatcgagagaaccatcagcaaggccagaggccaggcccaccagcccagcgtgtacgtgctgccccccagcagagaggagctgagcaagaacaccgtgagcctgacctgcctgatcaaggacttcttcccccccgacatcgacgtggagtggcagagcaacggccagcaggagcccgagagcaagtacagaaccacccccccccagctggacgaggacggcagctacttcctgtacagcaagctgagcgtggacaagagcagatggcagagaggcgacaccttcatctgcgccgtgatgcacgaggccctgcacaaccactacacccaggagagcctgagccacagccccggcaag

SEQ ID NO: 31580 - RNA, 654 nt, synthetic construct
  misc_feature 1..654: note = derived and/or modified sequence opt4 from Gilvetmab_LightChain
  source 1..654: mol_type = other RNA
gacatcgtgatgacccagacccccctgagcctgagcgtgagcctgggcgagcccgccagcatcagctgccacgccagccagaacatcaacgtgtggctgagctggtacagacagaagcccggccagatcccccagctgctgatctacaaggccagccacctgcacaccggcgtgcccgacagattcagcggcagcggcagcggcaccgacttcaccctgagaatcagcagagtggaggccgacgacgccggcgtgtactactgccagcagggccagagctggcccctgaccttcggccagggcaccaaggtggagatcaagagaaacgacgcccagcccgccgtgtacctgttccagcccagccccgaccagctgcacaccggcagcgccagcgtggtgtgcctgctgaacagcttctaccccaaggacatcaacgtgaagtggaaggtggacggcgtgatccaggacaccggcatccaggagagcgtgaccgagcaggacagcaaggacagcacctacagcctgagcagcaccctgaccatgagcagcaccgagtacctgagccacgagctgtacagctgcgagatcacccacaagagcctgcccagcaccctgatcaagagcttccagagaagcgagtgccagagagtggac

SEQ ID NO: 31581 - RNA, 1344 nt, synthetic construct; identical to SEQ ID NO: 30864
  misc_feature 1..1344: note = derived and/or modified sequence opt4 from Ifabotuzumab_HeavyChain
  source 1..1344: mol_type = other RNA

SEQ ID NO: 31582 - RNA, 642 nt, synthetic construct; identical to SEQ ID NO: 30865
  misc_feature 1..642: note = derived and/or modified sequence opt4 from Ifabotuzumab_LightChain
  source 1..642: mol_type = other RNA

SEQ ID NO: 31583 - RNA, 1323 nt, synthetic construct
  misc_feature 1..1323: note = derived and/or modified sequence opt4 from Iratumumab_HeavyChain
  source 1..1323: mol_type = other RNA
caggtgcagctgcagcagtggggcgccggcctgctgaagcccagcgagaccctgagcctgacctgcgccgtgtacggcggcagcttcagcgcctactactggagctggatcagacagccccccggcaagggcctggagtggatcggcgacatcaaccacggcggcggcaccaactacaaccccagcctgaagagcagagtgaccatcagcgtggacaccagcaagaaccagttcagcctgaagctgaacagcgtgaccgccgccgacaccgccgtgtactactgcgccagcctgaccgcctactggggccagggcagcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccacacccagaagagcctgagcctgagccccggcaag

SEQ ID NO: 31584 - RNA, 642 nt, synthetic construct
  misc_feature 1..642: note = derived and/or modified sequence opt4 from Iratumumab_LightChain
  source 1..642: mol_type = other RNA
gacatccagatgacccagagccccaccagcctgagcgccagcgtgggcgacagagtgaccatcacctgcagagccagccagggcatcagcagctggctgacctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacgacagctaccccatcaccttcggccagggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31585 - RNA, 1344 nt, synthetic construct
  misc_feature 1..1344: note = derived and/or modified sequence opt4 from Lacnotuzumab_HeavyChain
  source 1..1344: mol_type = other RNA
caggtgcagctgcaggagagcggccccggcctggtgaagcccagccagaccctgagcctgacctgcaccgtgagcgactacagcatcaccagcgactacgcctggaactggatcagacagttccccggcaagggcctggagtggatgggctacatcagctacagcggcagcaccagctacaaccccagcctgaagagcagaatcaccatcagcagagacaccagcaagaaccagttcagcctgcagctgaacagcgtgaccgccgccgacaccgccgtgtactactgcgccagcttcgactacgcccacgccatggactactggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31586 - RNA, 642 nt, synthetic construct
  misc_feature 1..642: note = derived and/or modified sequence opt4 from Lacnotuzumab_LightChain
  source 1..642: mol_type = other RNA
gacatcgtgctgacccagagccccgccttcctgagcgtgacccccggcgagaaggtgaccttcacctgccaggccagccagagcatcggcaccagcatccactggtaccagcagaagaccgaccaggcccccaagctgctgatcaagtacgccagcgagagcatcagcggcatccccagcagattcagcggcagcggcagcggcaccgacttcaccctgaccatcagcagcgtggaggccgaggacgccgccgactactactgccagcagatcaacagctggcccaccaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31587 - RNA, 1347 nt, synthetic construct
  misc_feature 1..1347: note = derived and/or modified sequence opt4 from Larcaviximab_HeavyChain
  source 1..1347: mol_type = other RNA
gaggtgcagctgcaggagagcggccccgagctggagatgcccggcgccagcgtgaagatcagctgcaaggccagcggcagcagcttcaccggcttcagcatgaactgggtgaagcagagcaacggcaagagcctggagtggatcggcaacatcgacacctactacggcggcaccacctacaaccagaagttcaagggcaaggccaccctgaccgtggacaagagcagcagcaccgcctacatgcagctgaagagcctgaccagcgaggacagcgccgtgtactactgcgccagaagcgcctactacggcagcaccttcgcctactggggccagggcaccctggtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31588 - RNA, 642 nt, synthetic construct
  misc_feature 1..642: note = derived and/or modified sequence opt4 from Larcaviximab_LightChain
  source 1..642: mol_type = other RNA
gacatccagatgacccagagccccgccagcctgagcgccagcgtgggcgagaccgtgaccatcacctgcagagccagcgagaacatctacagctacctggcctggtaccagcagaagcagggcaagagcccccagctgctggtgtacaacgccaagaccctgatcgagggcgtgcccagcagattcagcggcagcggcagcggcacccagttcagcctgaagatcaacagcctgcagcccgaggacttcggcagctacttctgccagcaccacttcggcacccccttcaccttcggcagcggcaccgagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31589 - RNA, 1338 nt, synthetic construct
  misc_feature 1..1338: note = derived and/or modified sequence opt4 from Lendalizumab_HeavyChain
  source 1..1338: mol_type = other RNA
caggtgcagctggtgcagagcggcgccgaggtgaagaagcccggcgccagcgtgaaggtgagctgcaaggccagcggctacaccttcaccgactacagcatggactgggtgagacaggcccccggccagggcctggagtggatgggcgccatccacctgaacaccggctacaccaactacaaccagaagttcaagggcagagtgaccatgaccagagacaccagcaccagcaccgtgtacatggagctgagcagcctgagaagcgaggacaccgccgtgtactactgcgccagaggcttctacgacggctacagccccatggactactggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31590 - RNA, 654 nt, synthetic construct
  misc_feature 1..654: note = derived and/or modified sequence opt4 from Lendalizumab_LightChain
  source 1..654: mol_type = other RNA
gacatccagatgacccagagccccagcagcctgagcgccagcgtgggcgacagagtgaccatcacctgcagagccagcgagagcgtggacagctacggcaacagcttcatgcactggtaccagcagaagcccggcaaggcccccaagctgctgatctacagagccagcaacctggagagcggcgtgcccagcagattcagcggcagcggcagcggcaccgacttcaccctgaccatcagcagcctgcagcccgaggacttcgccacctactactgccagcagagcaacgaggacccctacaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31591 - RNA, 1359 nt, synthetic construct
  misc_feature 1..1359: note = derived and/or modified sequence opt4 from Lesofavumab_HeavyChain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgagagcgagaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31592 - RNA, 657 nt, synthetic construct
  misc_feature 1..657: note = derived and/or modified sequence opt4 from Lesofavumab_LightChain
  source 1..657: mol_type = other RNA
gacatcgtgatgacccagagccccctgagcctgcccgtgacccccggcgagcccgccagcatcagctgcagaagcagccagagcctgctgagaagcaacggctacaactacctggactggtacctgcagaagcccggccagagcccccagctgctgatctacctgggcagcaacagagccagcggcgtgcccgacagattcagcggcagcggcagcggcaccgacttcaccctgaagatcagcagagtggaggccgaggacgtgggcgtgtactactgcatgcaggccctgcagaccccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31593 - RNA, 1059 nt, synthetic construct
  misc_feature 1..1059: note = derived and/or modified sequence opt4 from Letolizumab_HeavyChain
  source 1..1059: mol_type = other RNA
gaggtgcagctgctggagagcggcggcggcctggtgcagcccggcggcagcctgagactgagctgcgccgccagcggcttcaccttcaactgggagctgatgggctgggccagacaggcccccggcaagggcctggagtgggtgagcggcatcgagggccccggcgacgtgacctactacgccgacagcgtgaagggcagattcaccatcagcagagacaacagcaagaacaccctgtacctgcagatgaacagcctgagagccgaggacaccgccgtgtactactgcgtgaaggtgggcaaggacgccaagagcgactacagaggccagggcaccctggtgaccgtgagcagcgccagcaccgagcccaagagcagcgacaagacccacaccagcccccccagccccgcccccgagctgctgggcggcagcagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31594 - RNA, 1338 nt, synthetic construct
  misc_feature 1..1338: note = derived and/or modified sequence opt4 from Losatuxizumab_HeavyChain
  source 1..1338: mol_type = other RNA
gaggtgcagctgcaggagagcggccccggcctggtgaagcccagccagaccctgagcctgacctgcaccgtgagcggctacagcatcagcagagacttcgcctggaactggatcagacagccccccggcaagggcctggagtggatgggctacatcagctacaacggcaacaccagataccagcccagcctgaagagcagaatcaccatcagcagagacaccagcaagaaccagttcttcctgaagctgaacagcgtgaccgccgccgacaccgccacctactactgcgtgaccgccagcagaggcttcccctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31595 - RNA, 642 nt, synthetic construct; identical to SEQ ID NO: 30773
  misc_feature 1..642: note = derived and/or modified sequence opt4 from Losatuxizumab_LightChain
  source 1..642: mol_type = other RNA

SEQ ID NO: 31596 - RNA, 1338 nt, synthetic construct
  misc_feature 1..1338: note = derived and/or modified sequence opt4 from Lupartumab_HeavyChain
  source 1..1338: mol_type = other RNA
gaggtgcagctgctggagagcggcggcggcctggtgcagcccggcggcagcctgagactgagctgcgccgccagcggcttcaccttcagcaacgcctggatgagctgggtgagacaggcccccggcaagggcctggagtgggtgagctacatcagcagcagcggcagcaccatctactacgccgacagcgtgaagggcagattcaccatcagcagagacaacagcaagaacaccctgtacctgcagatgaacagcctgagagccgaggacaccgccgtgtactactgcgccagagagggcctgtgggccttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31597 - RNA, 651 nt, synthetic construct
  misc_feature 1..651: note = derived and/or modified sequence opt4 from Lupartumab_LightChain
  source 1..651: mol_type = other RNA
gagagcgtgctgacccagccccccagcgtgagcggcgcccccggccagagagtgaccatcagctgcaccggcagcagcagcaacatcggcgccggctacgtggtgcactggtaccagcagctgcccggcaccgcccccaagctgctgatctacgacaacaacaagagacccagcggcgtgcccgacagattcagcggcagcaagagcggcaccagcgccagcctggccatcagcggcctgagaagcgaggacgaggccgactactactgcgccgcctgggacgacagactgaacggccccgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31598 - RNA, 1731 nt, synthetic construct
  misc_feature 1..1731: note = derived and/or modified sequence opt4 from Lutikizumab_HeavyChain
  source 1..1731: mol_type = other RNA
gaggtgcagctggtggagagcggcggcggcgtggtgcagcccggcagaagcctgagactgagctgcagcgccagcggcttcatcttcagcagatacgacatgagctgggtgagacaggcccccggcaagggcctggagtgggtggcctacatcagccacggcggcgccggcacctactaccccgacagcgtgaagggcagattcaccatcagcagagacaacagcaagaacaccctgttcctgcagatggacagcctgagacccgaggacaccggcgtgtacttctgcgccagaggcggcgtgaccaagggctacttcgacgtgtggggccagggcacccccgtgaccgtgagcagcgccagcaccaagggcccccaggtgcagctggtggagagcggcggcggcgtggtgcagcccggcagaagcctgagactgagctgcaccgccagcggcttcaccttcagcatgttcggcgtgcactgggtgagacaggcccccggcaagggcctggagtgggtggccgccgtgagctacgacggcagcaacaagtactacgccgagagcgtgaagggcagattcaccatcagcagagacaacagcaagaacatcctgttcctgcagatggacagcctgagactggaggacaccgccgtgtactactgcgccagaggcagacccaaggtggtgatccccgcccccctggcccactggggccagggcaccctggtgaccttcagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31599 - RNA, 981 nt, synthetic construct
  misc_feature 1..981: note = derived and/or modified sequence opt4 from Lutikizumab_LightChain
  source 1..981: mol_type = other RNA
gacatccagatgacccagagccccagcagcctgagcgccagcgtgggcgacagagtgaccatcacctgcagagccagcggcaacatccacaactacctgacctggtaccagcagacccccggcaaggcccccaagctgctgatctacaacgccaagaccctggccgacggcgtgcccagcagattcagcggcagcggcagcggcaccgactacaccttcaccatcagcagcctgcagcccgaggacatcgccacctactactgccagcacttctggagcatcccctacaccttcggccagggcaccaagctgcagatcaccagaaccgtggccgcccccgacatccagatgacccagagccccagcagcgtgagcgccagcgtgggcgacagagtgaccatcacctgcagagccagccagggcatcagcagctggctggcctggtaccagcagaagcccggcaaggcccccaagctgctgatctacgaggccagcaacctggagaccggcgtgcccagcagattcagcggcagcggcagcggcagcgacttcaccctgaccatcagcagcctgcagcccgaggacttcgccacctactactgccagcagaccagcagcttcctgctgagcttcggcggcggcaccaaggtggagcacaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31600 - RNA, 1341 nt, synthetic construct
  misc_feature 1..1341: note = derived and/or modified sequence opt4 from Oleclumab_HeavyChain
  source 1..1341: mol_type = other RNA
gaggtgcagctgctggagagcggcggcggcctggtgcagcccggcggcagcctgagactgagctgcgccgccagcggcttcaccttcagcagctacgcctacagctgggtgagacaggcccccggcaagggcctggagtgggtgagcgccatcagcggcagcggcggcagaacctactacgccgacagcgtgaagggcagattcaccatcagcagagacaacagcaagaacaccctgtacctgcagatgaacagcctgagagccgaggacaccgccgtgtactactgcgccagactgggctacggcagagtggacgagtggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagttcgagggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgccagcatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31601 - RNA, 648 nt, synthetic construct
  misc_feature 1..648: note = derived and/or modified sequence opt4 from Oleclumab_LightChain
  source 1..648: mol_type = other RNA
cagagcgtgctgacccagccccccagcgccagcggcacccccggccagagagtgaccatcagctgcagcggcagcctgagcaacatcggcagaaaccccgtgaactggtaccagcagctgcccggcaccgcccccaagctgctgatctacctggacaacctgagactgagcggcgtgcccgacagattcagcggcagcaagagcggcaccagcgccagcctggccatcagcggcctgcagagcgaggacgaggccgactactactgcgccacctgggacgacagccaccccggctggaccttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31602 - RNA, 1449 nt, synthetic construct; identical to SEQ ID NO: 31217
  misc_feature 1..1449: note = derived and/or modified sequence opt4 from Otlertuzumab_HeavyChain
  source 1..1449: mol_type = other RNA

SEQ ID NO: 31603 - RNA, 339 nt, synthetic construct
  misc_feature 1..339: note = derived and/or modified sequence opt4 from Ozoralizumab_HeavyChain
  source 1..339: mol_type = other RNA
gaggtgcagctggtggagagcggcggcggcctggtgcagcccggcggcagcctgagactgagctgcgccgccagcggcttcaccttcagcgactactggatgtactgggtgagacaggcccccggcaagggcctggagtgggtgagcgagatcaacaccaacggcctgatcaccaagtaccccgacagcgtgaagggcagattcaccatcagcagagacaacgccaagaacaccctgtacctgcagatgaacagcctgagacccgaggacaccgccgtgtactactgcgccagaagccccagcggcttcaacagaggccagggcaccctggtgaccgtg

SEQ ID NO: 31604 - RNA, 1089 nt, synthetic construct; identical to SEQ ID NO: 31222
  misc_feature 1..1089: note = derived and/or modified sequence opt4 from Ozoralizumab_HeavyChain_HeavyChain_HeavyChain
  source 1..1089: mol_type = other RNA

SEQ ID NO: 31605 - RNA, 1494 nt, synthetic construct
  misc_feature 1..1494: note = derived and/or modified sequence opt4 from Pasotuxizumab_HeavyChain_LightChain_HeavyChain_LightChain
  source 1..1494: mol_type = other RNA
caggtgcagctggtggagagcggcggcggcctggtgaagcccggcgagagcctgagactgagctgcgccgccagcggcttcaccttcagcgactactacatgtactgggtgagacaggcccccggcaagggcctggagtgggtggccatcatcagcgacggcggctactacacctactacagcgacatcatcaagggcagattcaccatcagcagagacaacgccaagaacagcctgtacctgcagatgaacagcctgaaggccgaggacaccgccgtgtactactgcgccagaggcttccccctgctgagacacggcgccatggactactggggccagggcaccctggtgaccgtgagcagcggcggcggcggcagcggcggcggcggcagcggcggcggcggcagcgacatccagatgacccagagccccagcagcctgagcgccagcgtgggcgacagagtgaccatcacctgcaaggccagccagaacgtggacaccaacgtggcctggtaccagcagaagcccggccaggcccccaagagcctgatctacagcgccagctacagatacagcgacgtgcccagcagattcagcggcagcgccagcggcaccgacttcaccctgaccatcagcagcgtgcagagcgaggacttcgccacctactactgccagcagtacgacagctacccctacaccttcggcggcggcaccaagctggagatcaagagcggcggcggcggcagcgaggtgcagctggtggagagcggcggcggcctggtgcagcccggcggcagcctgaagctgagctgcgccgccagcggcttcaccttcaacaagtacgccatgaactgggtgagacaggcccccggcaagggcctggagtgggtggccagaatcagaagcaagtacaacaactacgccacctactacgccgacagcgtgaaggacagattcaccatcagcagagacgacagcaagaacaccgcctacctgcagatgaacaacctgaagaccgaggacaccgccgtgtactactgcgtgagacacggcaacttcggcaacagctacatcagctactgggcctactggggccagggcaccctggtgaccgtgagcagcggcggcggcggcagcggcggcggcggcagcggcggcggcggcagccagaccgtggtgacccaggagcccagcctgaccgtgagccccggcggcaccgtgaccctgacctgcggcagcagcaccggcgccgtgaccagcggcaactaccccaactgggtgcagcagaagcccggccaggcccccagaggcctgatcggcggcaccaagttcctggcccccggcacccccgccagattcagcggcagcctgctgggcggcaaggccgccctgaccctgagcggcgtgcagcccgaggacgaggccgagtactactgcgtgctgtggtacagcaacagatgggtgttcggcggcggcaccaagctgaccgtgctg

SEQ ID NO: 31606 - RNA, 357 nt, synthetic construct
  misc_feature 1..357: note = derived and/or modified sequence opt4 from Pasotuxizumab_HeavyChain1
  source 1..357: mol_type = other RNA
caggtgcagctggtggagagcggcggcggcctggtgaagcccggcgagagcctgagactgagctgcgccgccagcggcttcaccttcagcgactactacatgtactgggtgagacaggcccccggcaagggcctggagtgggtggccatcatcagcgacggcggctactacacctactacagcgacatcatcaagggcagattcaccatcagcagagacaacgccaagaacagcctgtacctgcagatgaacagcctgaaggccgaggacaccgccgtgtactactgcgccagaggcttccccctgctgagacacggcgccatggactactggggccagggcaccctggtgaccgtg

SEQ ID NO: 31607 - RNA, 369 nt, synthetic construct
  misc_feature 1..369: note = derived and/or modified sequence opt4 from Pasotuxizumab_HeavyChain2
  source 1..369: mol_type = other RNA
gaggtgcagctggtggagagcggcggcggcctggtgcagcccggcggcagcctgaagctgagctgcgccgccagcggcttcaccttcaacaagtacgccatgaactgggtgagacaggcccccggcaagggcctggagtgggtggccagaatcagaagcaagtacaacaactacgccacctactacgccgacagcgtgaaggacagattcaccatcagcagagacgacagcaagaacaccgcctacctgcagatgaacaacctgaagaccgaggacaccgccgtgtactactgcgtgagacacggcaacttcggcaacagctacatcagctactgggcctactggggccagggcaccctggtgaccgtg

SEQ ID NO: 31608 - RNA, 321 nt, synthetic construct
  misc_feature 1..321: note = derived and/or modified sequence opt4 from Pasotuxizumab_LightChain1
  source 1..321: mol_type = other RNA
gacatccagatgacccagagccccagcagcctgagcgccagcgtgggcgacagagtgaccatcacctgcaaggccagccagaacgtggacaccaacgtggcctggtaccagcagaagcccggccaggcccccaagagcctgatctacagcgccagctacagatacagcgacgtgcccagcagattcagcggcagcgccagcggcaccgacttcaccctgaccatcagcagcgtgcagagcgaggacttcgccacctactactgccagcagtacgacagctacccctacaccttcggcggcggcaccaagctggagatcaag

SEQ ID NO: 31609 - RNA, 327 nt, synthetic construct
  misc_feature 1..327: note = derived and/or modified sequence opt4 from Pasotuxizumab_LightChain2
  source 1..327: mol_type = other RNA
cagaccgtggtgacccaggagcccagcctgaccgtgagccccggcggcaccgtgaccctgacctgcggcagcagcaccggcgccgtgaccagcggcaactaccccaactgggtgcagcagaagcccggccaggcccccagaggcctgatcggcggcaccaagttcctggcccccggcacccccgccagattcagcggcagcctgctgggcggcaaggccgccctgaccctgagcggcgtgcagcccgaggacgaggccgagtactactgcgtgctgtggtacagcaacagatgggtgttcggcggcggcaccaagctgaccgtgctg

SEQ ID NO: 31610 - RNA, 1023 nt, synthetic construct; identical to SEQ ID NO: 31266
  misc_feature 1..1023: note = derived and/or modified sequence opt4 from Placulumab_HeavyChain
  source 1..1023: mol_type = other RNA

SEQ ID NO: 31611 - RNA, 1353 nt, synthetic construct
  misc_feature 1..1353: note = derived and/or modified sequence opt4 from Porgaviximab_HeavyChain
  source 1..1353: mol_type = other RNA
gaggtgcagctgcaggagagcggcggcggcctgatgcagcccggcggcagcatgaagctgagctgcgtggccagcggcttcaccttcagcaactactggatgaactgggtgagacagagccccgagaagggcctggagtgggtggccgagatcagactgaagagcaacaactacgccacccactacgccgagagcgtgaagggcagattcaccatcagcagagacgacagcaagagaagcgtgtacctgcagatgaacaccctgagagccgaggacaccggcatctactactgcaccagaggcaacggcaactacagagccatggactactggggccagggcaccagcgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31612 - RNA, 642 nt, synthetic construct
  misc_feature 1..642: note = derived and/or modified sequence opt4 from Porgaviximab_LightChain
  source 1..642: mol_type = other RNA
gacatccagatgacccagagccccgccagcctgagcgtgagcgtgggcgagaccgtgagcatcacctgcagagccagcgagaacatctacagcagcctggcctggtaccagcagaagcagggcaagagcccccagctgctggtgtacagcgccaccatcctggccgacggcgtgcccagcagattcagcggcagcggcagcggcacccagtacagcctgaagatcaacagcctgcagagcgaggacttcggcacctactactgccagcacttctggggcaccccctacaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31613 - RNA, 1341 nt, synthetic construct
  misc_feature 1..1341: note = derived and/or modified sequence opt4 from Prezalumab_HeavyChain
  source 1..1341: mol_type = other RNA
gaggtgcagctggtggagagcggcggcggcctggtgcagcccggcggcagcctgagactgagctgcgccgccagcggcttcaccttcagcagctactggatgagctgggtgagacaggcccccggcaagggcctggagtgggtggcctacatcaagcaggacggcaacgagaagtactacgtggacagcgtgaagggcagattcaccatcagcagagacaacgccaagaacagcctgtacctgcagatgaacagcctgagagccgaggacaccgccgtgtactactgcgccagagagggcatcctgtggttcggcgacctgcccaccttctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31614 - RNA, 642 nt, synthetic construct
  misc_feature 1..642: note = derived and/or modified sequence opt4 from Prezalumab_LightChain
  source 1..642: mol_type = other RNA
gacatccagatgacccagagccccagcagcctgagcgccagcgtgggcgacagagtgaccatcacctgcagagccagccagggcatcagcaactggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacgacagctaccccagaaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31615 - RNA, 342 nt, synthetic construct
  misc_feature 1..342: note = derived and/or modified sequence opt4 from Radretumab_HeavyChain
  source 1..342: mol_type = other RNA
gaggtgcagctgctggagagcggcggcggcctggtgcagcccggcggcagcctgagactgagctgcgccgccagcggcttcaccttcagcagcttcagcatgagctgggtgagacaggcccccggcaagggcctggagtgggtgagcagcatcagcggcagcagcggcaccacctactacgccgacagcgtgaagggcagattcaccatcagcagagacaacagcaagaacaccctgtacctgcagatgaacagcctgagagccgaggacaccgccgtgtactactgcgccaagcccttcccctacttcgactactggggccagggcaccctggtgaccgtg

SEQ ID NO: 31616 - RNA, 1071 nt, synthetic construct; identical to SEQ ID NO: 31285
  misc_feature 1..1071: note = derived and/or modified sequence opt4 from Radretumab_HeavyChain_LightChain
  source 1..1071: mol_type = other RNA

SEQ ID NO: 31617 - RNA, 693 nt, synthetic construct
  misc_feature 1..693: note = derived and/or modified sequence opt4 from Radretumab_LightChain
  source 1..693: mol_type = other RNA
gccagcgagatcgtgctgacccagagccccggcaccctgagcctgagccccggcgagagagccaccctgagctgcagagccagccagagcgtgagcagcagcttcctggcctggtaccagcagaagcccggccaggcccccagactgctgatctactacgccagcagcagagccaccggcatccccgacagattcagcggcagcggcagcggcaccgacttcaccctgaccatcagcagactggagcccgaggacttcgccgtgtactactgccagcagaccggcagaatcccccccaccttcggccagggcaccaaggtggagatcaagagcggcggcagcggcggccccagagccgcccccgaggtgtacgccttcgccacccccgagtggcccggcagcagagacaagagaaccctggcctgcctgatccagaacttcatgcccgaggacatcagcgtgcagtggctgcacaacgaggtgcagctgcccgacgccagacacagcaccacccagcccagaaagaccaagggcagcggcttcttcgtgttcagcagactggaggtgaccagagccgagtgggagcagaaggacgagttcatctgcagagccgtgcacgaggccgccagccccagccagaccgtgcagagagccgtgagcgtgaaccccgagagcagcagaagaggcggctgc

SEQ ID NO: 31618 - RNA, 1359 nt, synthetic construct
  misc_feature 1..1359: note = derived and/or modified sequence opt4 from Ranevetmab_HeavyChain1
  source 1..1359: mol_type = other RNA
gaggtgcagctggtggagagcggcggcggcctggtgcagcccggcggcagcctgagactgagctgcgtggccagcggcttcagcctgaccaacaacaacgtgaactgggtgagacaggcccccggcaagggcctggagtgggtgggcggcgtgtgggccggcggcgccaccgactacaacagcgccctgaagagcagattcaccatcagcagagacaacgccaagaacaccgtgttcctgcagatgcacagcctgagaagcgaggacaccgccgtgtactactgcgccagagacggcggctacagcagcagcaccctgtacgccatggacgcctggggccagggcaccagcgtgaccgtgagcagcgccagcaccaccgcccccagcgtgttccccctggcccccagctgcggcagcaccagcggcagcaccgtggccctggcctgcctggtgagcggctacttccccgagcccgtgaccgtgagctggaacagcggcagcctgaccagcggcgtgcacaccttccccagcgtgctgcagagcagcggcctgcacagcctgagcagcatggtgaccgtgcccagcagcagatggcccagcgagaccttcacctgcaacgtggtgcaccccgccagcaacaccaaggtggacaagcccgtgttcaacgagtgcagatgcaccgacacccccccctgccccgtgcccgagcccctgggcggccccagcgtgctgatcttcccccccaagcccaaggacatcctgagaatcaccagaacccccgaggtgacctgcgtggtgctggacctgggcagagaggaccccgaggtgcagatcagctggttcgtggacggcaaggaggtgatcaccgccaagacccagagcagagagcagcagttcaacggcacctaccaggtggtgagcgtgctgcccatcgagcaccaggactggctgaccggcaaggagttcaagtgcagagtgaaccacatcgacctgcccagccccatcgagagaaccatcagcaaggccagaggcagagcccacaagcccagcgtgtacgtgctgccccccagccccaaggagctgagcagcagcgacaccgtgagcatcacctgcctgatcaaggacttctacccccccgacatcgacgtggagtggcagagcgtgggccagcaggagcccgagagaaagcacagaatgacccccccccagctggacgaggacggcagctacttcctgtacagcaagctgagcgtggacaagagcagatggcagcagggcgaccccttcacctgcgccgtgatgcacgagaccctgcagaaccactacaccgacctgagcctgagccacagccccggcaag

SEQ ID NO: 31619 - RNA, 1359 nt, synthetic construct
  misc_feature 1..1359: note = derived and/or modified sequence opt4 from Ranevetmab_HeavyChain2
  source 1..1359: mol_type = other RNA
gaggtgcagctggtggagagcggcggcggcctggtgcagcccggcggcagcctgagactgagctgcgtggccagcggcttcagcctgaccaacaacaacgtgaactgggtgagacaggcccccggcaagggcctggagtgggtgggcggcgtgtgggccggcggcgccaccgactacaacagcgccctgaagagcagattcaccatcagcagagacaacgccaagaacaccgtgttcctgcagatgcacagcctgagaagcgaggacaccgccgtgtactactgcgccagagacggcggctacagcagcagcaccctgtacgccatggacgcctggggccagggcaccagcgtgaccgtgagcagcgccagcaccaccgcccccagcgtgttccccctggcccccagctgcggcagcaccagcggcagcaccgtggccctggcctgcctggtgagcggctacttccccgagcccgtgaccgtgagctggaacagcggcagcctgaccagcggcgtgcacaccttccccagcgtgctgcagagcagcggcctgcacagcctgagcagcatggtgaccgtgcccagcagcagatggcccagcgagaccttcacctgcaacgtggtgcaccccgccagcaacaccaaggtggacaagcccgtgttcaacgagtgcagatgcaccgacacccccccctgccccgtgcccgagcccctgggcggccccagcgtgctgatcttcccccccaagcccaaggacatcctgagaatcaccagaacccccgaggtgacctgcgtggtgctggacctgggcagagaggaccccgaggtgcagatcagctggttcgtggacggcaaggaggtgctgaccgccaagacccagagcagagagcagcagttcaacggcacctaccaggtggtgagcgtgctgcccatcgagcaccaggactggctgaccggcaaggagttcaagtgcagagtgaaccacatcgacctgcccagccccatcgagagaaccatcagcaaggccagaggcagagcccacaagcccagcgtgtacgtgctgccccccagccccaaggagctgagcagcagcgacaccgtgagcatcacctgcctgatcaaggacttctacccccccgacatcgacgtggagtggcagagcgtgggccagcaggagcccgagagaaagcacagaatgacccccccccagctggacgaggacggcagctacttcctgtacagcaagctgagcgtggacaagagcagatggcagcagggcgaccccttcacctgcgccgtgatgcacgagaccctgcagaaccactacaccgacctgagcctgagccacagccccggcaag

SEQ ID NO: 31620 - RNA, 651 nt, synthetic construct
  misc_feature 1..651: note = derived and/or modified sequence opt4 from Ranevetmab_LightChain
  source 1..651: mol_type = other RNA
gacatcgtgatgacccagagccccgccagcctgagcctgagccagggcgagaccgtgaccatcacctgcagagccagcgaggacatctacaacgccctggcctggtaccagcagaagcccggccaggcccccaagctgctgatctacaacaccgacaccctgcacaccggcgtgcccagcagattcagcggcagcggcagcggcaccgacttcagcctgaccatcagcagcctggagcccgaggacgtggccgtgtactactgccagcactacttccactaccccagaaccttcggccagggcaccaaggtggagctgaagagaaacgacgcccagcccgccgtgtacctgttccagcccagccccgaccagctgcacaccggcagcgccagcgtggtgtgcctgctgaacagcttctaccccaaggacatcaacgtgaagtggaaggtggacggcgtgatccaggacaccggcatccaggagagcgtgaccgagcaggacaaggacagcacctacagcctgagcagcaccctgaccatgagcagcaccgagtacctgagccacgagctgtacagctgcgagatcacccacaagagcctgcccagcaccctgatcaagagcttccagagaagcgagtgccagagagtggac

SEQ ID NO: 31621 - RNA, 1761 nt, synthetic construct
  misc_feature 1..1761: note = derived and/or modified sequence opt4 from Remtolumab_HeavyChain
  source 1..1761: mol_type = other RNA
gaggtgcagctggtggagagcggcggcggcctggtgcagcccggcagaagcctgagactgagctgcgccgccagcggcttcaccttcgacgactacgccatgcactgggtgagacaggcccccggcaagggcctggagtgggtgagcgccatcacctggaacagcggccacatcgactacgccgacagcgtggagggcagattcaccatcagcagagacaacgccaagaacagcctgtacctgcagatgaacagcctgagagccgaggacaccgccgtgtactactgcgccaaggtgagctacctgagcaccgccagcagcctggactactggggccagggcaccctggtgaccgtgagcagcggcggcggcggcagcggcggcggcggcagcgaggtgcagctggtgcagagcggcgccgaggtgaagaagcccggcagcagcgtgaaggtgagctgcaaggccagcggcggcagcttcggcggctacggcatcggctgggtgagacaggcccccggccagggcctggagtggatgggcggcatcacccccttcttcggcttcgccgactacgcccagaagttccagggcagagtgaccatcaccgccgacgagagcaccaccaccgcctacatggagctgagcggcctgaccagcgacgacaccgccgtgtactactgcgccagagaccccaacgagttctggaacggctactacagcacccacgacttcgacagctggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31622 - RNA, 993 nt, synthetic construct
  misc_feature 1..993: note = derived and/or modified sequence opt4 from Remtolumab_LightChain
  source 1..993: mol_type = other RNA
gacatccagatgacccagagccccagcagcctgagcgccagcgtgggcgacagagtgaccatcacctgcagagccagccagggcatcagaaactacctggcctggtaccagcagaagcccggcaaggcccccaagctgctgatctacgccgccagcaccctgcagagcggcgtgcccagcagattcagcggcagcggcagcggcaccgacttcaccctgaccatcagcagcctgcagcccgaggacgtggccacctactactgccagagatacaacagagccccctacaccttcggccagggcaccaaggtggagatcaagagaggcggcagcggcggcggcggcagcggcgagatcgtgctgacccagagccccgacttccagagcgtgacccccaaggagaaggtgaccatcacctgcagagccagccaggacatcggcagcgagctgcactggtaccagcagaagcccgaccagccccccaagctgctgatcaagtacgccagccacagcaccagcggcgtgcccagcagattcagcggcagcggcagcggcaccgacttcaccctgaccatcaacggcctggaggccgaggacgccggcacctactactgccaccagaccgacagcctgccctacaccttcggccccggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31623 - RNA, 1341 nt, synthetic construct
  misc_feature 1..1341: note = derived and/or modified sequence opt4 from Rosmantuzumab_HeavyChain
  source 1..1341: mol_type = other RNA
caggtgcagctggtgcagagcggcgccgaggtgaagaagcccggcgccagcgtgaaggtgagctgcaaggccagcggctacaccttcaccgactacagcatccactgggtgagacaggcccccggccagggcctggagtggatcggctacatctaccccagcaacggcgacagcggctacaaccagaagttcaagaacagagtgaccatgaccagagacaccagcaccagcaccgcctacatggagctgagcagactgagaagcgaggacaccgccgtgtactactgcgccacctacttcgccaacaacttcgactactggggccagggcaccaccctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31624 - RNA, 654 nt, synthetic construct
  misc_feature 1..654: note = derived and/or modified sequence opt4 from Rosmantuzumab_LightChain
  source 1..654: mol_type = other RNA
gacatccagatgacccagagccccagcagcctgagcgccagcgtgggcgacagagtgaccatcacctgcaaggccagccagagcgtggactacgacggcgacagctacatgaactggtaccagcagaagcccggcaaggcccccaagctgctgatctacgccgccagcaacctggagagcggcgtgcccagcagattcagcggcagcggcagcggcaccgacttcaccctgaccatcagccccgtgcaggccgaggacttcgccacctactactgccagcagagcaacgaggaccccctgaccttcggcgccggcaccaagctggagctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31625 - RNA, 1332 nt, synthetic construct
  misc_feature 1..1332: note = derived and/or modified sequence opt4 from Rozanolixizumab_HeavyChain
  source 1..1332: mol_type = other RNA
gaggtgcccctggtggagagcggcggcggcctggtgcagcccggcggcagcctgagactgagctgcgccgtgagcggcttcaccttcagcaactacggcatggtgtgggtgagacaggcccccggcaagggcctggagtgggtggcctacatcgacagcgacggcgacaacacctactacagagacagcgtgaagggcagattcaccatcagcagagacaacgccaagagcagcctgtacctgcagatgaacagcctgagagccgaggacaccgccgtgtactactgcaccaccggcatcgtgagacccttcctgtactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtggagagcaagtacggccccccctgccccccctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 31626 - RNA, 657 nt, synthetic construct
  misc_feature 1..657: note = derived and/or modified sequence opt4 from Rozanolixizumab_LightChain
  source 1..657: mol_type = other RNA
gacatccagatgacccagagccccagcagcctgagcgccagcgtgggcgacagagtgaccatcacctgcaagagcagccagagcctggtgggcgccagcggcaagacctacctgtactggctgttccagaagcccggcaaggcccccaagagactgatctacctggtgagcaccctggacagcggcatccccagcagattcagcggcagcggcagcggcaccgagttcaccctgaccatcagcagcctgcagcccgaggacttcgccacctactactgcctgcagggcacccacttcccccacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31627 - RNA, 1329 nt, synthetic construct
  misc_feature 1..1329: note = derived and/or modified sequence opt4 from Sapelizumab_HeavyChain
  source 1..1329: mol_type = other RNA
caggtgcagctgcaggagagcggccccggcctggtgaagcccagcgagaccctgagcctgacctgcgccgtgagcggccacagcatcagccacgaccacgcctggagctgggtgagacagccccccggcgagggcctggagtggatcggcttcatcagctacagcggcatcaccaactacaaccccagcctgcagggcagagtgaccatcagcagagacaacagcaagaacaccctgtacctgcagatgaacagcctgagagccgaggacaccgccgtgtactactgcgccagaagcctggccagaaccaccgccatggactactggggcgagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagagctgcgtggagtgccccccctgccccgccccccccgtggccggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcaggagggcaacgtgttcagctgcagcgtgatgcacgaggccctgcacgcccactacacccagaagagcctgagcctgagcccc

SEQ ID NO: 31628 - RNA, 642 nt, synthetic construct
  misc_feature 1..642: note = derived and/or modified sequence opt4 from Sapelizumab_LightChain
  source 1..642: mol_type = other RNA
gacatccagatgacccagagccccagcagcctgagcgccagcgtgggcgacagcgtgaccatcacctgccaggccagcaccgacatcagcagccacctgaactggtaccagcagaagcccggcaaggcccccgagctgctgatctactacggcagccacctgctgagcggcgtgcccagcagattcagcggcagcggcagcggcaccgacttcaccttcaccatcagcagcctggaggccgaggacgccgccacctactactgcggccagggcaacagactgccctacaccttcggccagggcaccaaggtggagatcgagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31629 - RNA, 1356 nt, synthetic construct
  misc_feature 1..1356: note = derived and/or modified sequence opt4 from Selicrelumab_HeavyChain
  source 1..1356: mol_type = other RNA
caggtgcagctggtgcagagcggcgccgaggtgaagaagcccggcgccagcgtgaaggtgagctgcaaggccagcggctacaccttcaccggctactacatgcactgggtgagacaggcccccggccagggcctggagtggatgggctggatcaaccccgacagcggcggcaccaactacgcccagaagttccagggcagagtgaccatgaccagagacaccagcatcagcaccgcctacatggagctgaacagactgagaagcgacgacaccgccgtgtactactgcgccagagaccagcccctgggctactgcaccaacggcgtgtgcagctacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31630 - RNA, 642 nt, synthetic construct
  misc_feature 1..642: note = derived and/or modified sequence opt4 from Selicrelumab_LightChain
  source 1..642: mol_type = other RNA
gacatccagatgacccagagccccagcagcgtgagcgccagcgtgggcgacagagtgaccatcacctgcagagccagccagggcatctacagctggctggcctggtaccagcagaagcccggcaaggcccccaacctgctgatctacaccgccagcaccctgcagagcggcgtgcccagcagattcagcggcagcggcagcggcaccgacttcaccctgaccatcagcagcctgcagcccgaggacttcgccacctactactgccagcaggccaacatcttccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31631 - RNA, 354 nt, synthetic construct
  misc_feature 1..354: note = derived and/or modified sequence opt4 from Solitomab_HeavyChain1
  source 1..354: mol_type = other RNA
gaggtgcagctgctggagcagagcggcgccgagctggtgagacccggcaccagcgtgaagatcagctgcaaggccagcggctacgccttcaccaactactggctgggctgggtgaagcagagacccggccacggcctggagtggatcggcgacatcttccccggcagcggcaacatccactacaacgagaagttcaagggcaaggccaccctgaccgccgacaagagcagcagcaccgcctacatgcagctgagcagcctgaccttcgaggacagcgccgtgtacttctgcgccagactgagaaactgggacgagcccatggactactggggccagggcaccaccgtgaccgtg

SEQ ID NO: 31632 - RNA, 375 nt, synthetic construct
  misc_feature 1..375: note = derived and/or modified sequence opt4 from Solitomab_HeavyChain2
  source 1..375: mol_type = other RNA
gacgtgcagctggtgcagagcggcgccgaggtgaagaagcccggcgccagcgtgaaggtgagctgcaaggccagcggctacaccttcaccagatacaccatgcactgggtgagacaggcccccggccagggcctggagtggatcggctacatcaaccccagcagaggctacaccaactacgccgacagcgtgaagggcagattcaccatcaccaccgacaagagcaccagcaccgcctacatggagctgagcagcctgagaagcgaggacaccgccacctactactgcgccagatactacgacgaccactactgcctggactactggggccagggcaccaccgtgaccgtgagcagcggcgagggcaccagcacc

SEQ ID NO: 31633 - RNA, 1488 nt, synthetic construct
  misc_feature 1..1488: note = derived and/or modified sequence opt4 from Solitomab_LightChain_HeavyChain_HeavyChain_LightChain
  source 1..1488: mol_type = other RNA
gagctggtgatgacccagagccccagcagcctgaccgtgaccgccggcgagaaggtgaccatgagctgcaagagcagccagagcctgctgaacagcggcaaccagaagaactacctgacctggtaccagcagaagcccggccagccccccaagctgctgatctactgggccagcaccagagagagcggcgtgcccgacagattcaccggcagcggcagcggcaccgacttcaccctgaccatcagcagcgtgcaggccgaggacctggccgtgtactactgccagaacgactacagctaccccctgaccttcggcgccggcaccaagctggagatcaagggcggcggcggcagcggcggcggcggcagcggcggcggcggcagcgaggtgcagctgctggagcagagcggcgccgagctggtgagacccggcaccagcgtgaagatcagctgcaaggccagcggctacgccttcaccaactactggctgggctgggtgaagcagagacccggccacggcctggagtggatcggcgacatcttccccggcagcggcaacatccactacaacgagaagttcaagggcaaggccaccctgaccgccgacaagagcagcagcaccgcctacatgcagctgagcagcctgaccttcgaggacagcgccgtgtacttctgcgccagactgagaaactgggacgagcccatggactactggggccagggcaccaccgtgaccgtgagcagcggcggcggcggcagcgacgtgcagctggtgcagagcggcgccgaggtgaagaagcccggcgccagcgtgaaggtgagctgcaaggccagcggctacaccttcaccagatacaccatgcactgggtgagacaggcccccggccagggcctggagtggatcggctacatcaaccccagcagaggctacaccaactacgccgacagcgtgaagggcagattcaccatcaccaccgacaagagcaccagcaccgcctacatggagctgagcagcctgagaagcgaggacaccgccacctactactgcgccagatactacgacgaccactactgcctggactactggggccagggcaccaccgtgaccgtgagcagcggcgagggcaccagcaccggcagcggcggcagcggcggcagcggcggcgccgacgacatcgtgctgacccagagccccgccaccctgagcctgagccccggcgagagagccaccctgagctgcagagccagccagagcgtgagctacatgaactggtaccagcagaagcccggcaaggcccccaagagatggatctacgacaccagcaaggtggccagcggcgtgcccgccagattcagcggcagcggcagcggcaccgactacagcctgaccatcaacagcctggaggccgaggacgccgccacctactactgccagcagtggagcagcaaccccctgaccttcggcggcggcaccaaggtggagatcaag

SEQ ID NO: 31634 - RNA, 339 nt, synthetic construct
  misc_feature 1..339: note = derived and/or modified sequence opt4 from Solitomab_LightChain1
  source 1..339: mol_type = other RNA
gagctggtgatgacccagagccccagcagcctgaccgtgaccgccggcgagaaggtgaccatgagctgcaagagcagccagagcctgctgaacagcggcaaccagaagaactacctgacctggtaccagcagaagcccggccagccccccaagctgctgatctactgggccagcaccagagagagcggcgtgcccgacagattcaccggcagcggcagcggcaccgacttcaccctgaccatcagcagcgtgcaggccgaggacctggccgtgtactactgccagaacgactacagctaccccctgaccttcggcgccggcaccaagctggagatcaag

SEQ ID NO: 31635 - RNA, 324 nt, synthetic construct
  misc_feature 1..324: note = derived and/or modified sequence opt4 from Solitomab_LightChain2
  source 1..324: mol_type = other RNA
gccgacgacatcgtgctgacccagagccccgccaccctgagcctgagccccggcgagagagccaccctgagctgcagagccagccagagcgtgagctacatgaactggtaccagcagaagcccggcaaggcccccaagagatggatctacgacaccagcaaggtggccagcggcgtgcccgccagattcagcggcagcggcagcggcaccgactacagcctgaccatcaacagcctggaggccgaggacgccgccacctactactgccagcagtggagcagcaaccccctgaccttcggcggcggcaccaaggtggagatcaag

SEQ ID NO: 31636 - RNA, 1359 nt, synthetic construct
  misc_feature 1..1359: note = derived and/or modified sequence opt4 from Suptavumab_HeavyChain2
  source 1..1359: mol_type = other RNA
gaggtgcagctggtggagagcggcggcgacctggtgcagcccggcagaagcctgagactgagctgcgtggccagcggcttcaccttcgacgactacgccatgcactgggtgagacaggcccccggcaagggcctggagtgggtgagcggcgtgagctggagcggcagcaccgtgggctacgccgacagcgtgaagggcagattcaccgtgagcagagacaacgcccagaagagcctgtacctgcagatgaacagcctgagagccgaggacaccgccctgtactactgcgtgaaggacgcctacaagttcaactactactactacggcctggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31637 - RNA, 1356 nt, synthetic construct
  misc_feature 1..1356: note = derived and/or modified sequence opt4 from Suvratoxumab_HeavyChain
  source 1..1356: mol_type = other RNA
gaggtgcagctggtggagagcggcggcggcctggtgcagcccggcggcagcctgagactgagctgcgccgccagcggcttcaccttcagcagccacgacatgcactgggtgagacaggccaccggcaagggcctggagtgggtgagcggcatcggcaccgccggcgacacctactaccccgacagcgtgaagggcagattcaccatcagcagagagaacgccaagaacagcctgtacctgcagatgaacagcctgagagccggcgacaccgccgtgtactactgcgccagagacagatacagccccaccggccactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgtacatcaccagagagcccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31638 - RNA, 639 nt, synthetic construct
  misc_feature 1..639: note = derived and/or modified sequence opt4 from Suvratoxumab_LightChain
  source 1..639: mol_type = other RNA
gacatccagatgacccagagccccagcaccctgagcgccagcgtgggcgacagagtgaccatcacctgcagagccagccagagcatcagcagctggctggcctggtaccagcagaagcccggcaaggcccccaagctgctgatctacaaggccagcagcctggagagcggcgtgcccagcagattcagcggcagcggcagcggcaccgagttcaccctgaccatcagcagcctgcagcccgacgacttcgccacctactactgcaagcagtacgccgactactggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31639 - RNA, 642 nt, synthetic construct
  misc_feature 1..642: note = derived and/or modified sequence opt4 from Tadocizumab_LightChain
  source 1..642: mol_type = other RNA
gacatccagatgacccagacccccagcaccctgagcgccagcgtgggcgacagagtgaccatcagctgcagagccagccaggacatcaacaactacctgaactggtaccagcagaagcccggcaaggcccccaagctgctgatctactacaccagcaccctgcacagcggcgtgcccagcagattcagcggcagcggcagcggcaccgactacaccctgaccatcagcagcctgcagcccgacgacttcgccacctacttctgccagcagggcaacaccctgccctggaccttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31640 - RNA, 1341 nt, synthetic construct
  misc_feature 1..1341: note = derived and/or modified sequence opt4 from Tanezumab_HeavyChain
  source 1..1341: mol_type = other RNA
caggtgcagctgcaggagagcggccccggcctggtgaagcccagcgagaccctgagcctgacctgcaccgtgagcggcttcagcctgatcggctacgacctgaactggatcagacagccccccggcaagggcctggagtggatcggcatcatctggggcgacggcaccaccgactacaacagcgccgtgaagagcagagtgaccatcagcaaggacaccagcaagaaccagttcagcctgaagctgagcagcgtgaccgccgccgacaccgccgtgtactactgcgccagaggcggctactggtacgccaccagctactacttcgactactggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31641 - RNA, 642 nt, synthetic construct
  misc_feature 1..642: note = derived and/or modified sequence opt4 from Tanezumab_LightChain
  source 1..642: mol_type = other RNA
gacatccagatgacccagagccccagcagcctgagcgccagcgtgggcgacagagtgaccatcacctgcagagccagccagagcatcagcaacaacctgaactggtaccagcagaagcccggcaaggcccccaagctgctgatctactacaccagcagattccacagcggcgtgcccagcagattcagcggcagcggcagcggcaccgacttcaccttcaccatcagcagcctgcagcccgaggacatcgccacctactactgccagcaggagcacaccctgccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31642 - RNA, 1353 nt, synthetic construct
  misc_feature 1..1353: note = derived and/or modified sequence opt4 from Tavolixizumab_HeavyChain
  source 1..1353: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagtacagcctgcagctgaacagcgtgacccccgaggacaccgccgtgtactactgcgccagatacaagtacgactacgacggcggccacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagccccaggaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31643 - RNA, 642 nt, synthetic construct
  misc_feature 1..642: note = derived and/or modified sequence opt4 from Tavolixizumab_LightChain
  source 1..642: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcaagctgcacagcggcgtgcccagcagattcagcggcagcggcagcggcaccgactacaccctgaccatcagcagcctgcagcccgaggacttcgccacctactactgccagcagggcagcgccctgccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31644 - RNA, 1335 nt, synthetic construct
  misc_feature 1..1335: note = derived and/or modified sequence opt4 from Telisotuzumab_HeavyChain
  source 1..1335: mol_type = other RNA
caggtgcagctggtgcagagcggcgccgaggtgaagaagcccggcgccagcgtgaaggtgagctgcaaggccagcggctacatcttcaccgcctacaccatgcactgggtgagacaggcccccggccagggcctggagtggatgggctggatcaagcccaacaacggcctggccaactacgcccagaagttccagggcagagtgaccatgaccagagacaccagcatcagcaccgcctacatggagctgagcagactgagaagcgacgacaccgccgtgtactactgcgccagaagcgagatcaccaccgagttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgactgccactgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 31645 - RNA, 654 nt, synthetic construct
  misc_feature 1..654: note = derived and/or modified sequence opt4 from Telisotuzumab_LightChain
  source 1..654: mol_type = other RNA
gacatcgtgatgacccagagccccgacagcctggccgtgagcctgggcgagagagccaccatcaactgcaagagcagcgagagcgtggacagctacgccaacagcttcctgcactggtaccagcagaagcccggccagccccccaagctgctgatctacagagccagcaccagagagagcggcgtgcccgacagattcagcggcagcggcagcggcaccgacttcaccctgaccatcagcagcctgcaggccgaggacgtggccgtgtactactgccagcagagcaaggaggaccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31646 - RNA, 1335 nt, synthetic construct; identical to SEQ ID NO: 31644
  misc_feature 1..1335: note = derived and/or modified sequence opt4 from Telisotuzumab_vedotin_HeavyChain
  source 1..1335: mol_type = other RNA

SEQ ID NO: 31647 - RNA, 654 nt, synthetic construct; identical to SEQ ID NO: 31645
  misc_feature 1..654: note = derived and/or modified sequence opt4 from Telisotuzumab_vedotin_LightChain
  source 1..654: mol_type = other RNA

SEQ ID NO: 31648 - RNA, 1350 nt, synthetic construct
  misc_feature 1..1350: note = derived and/or modified sequence opt4 from Timigutuzumab_HeavyChain
  source 1..1350: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 31649 - RNA, 642 nt, synthetic construct; identical to SEQ ID NO: 31310
  misc_feature 1..642: note = derived and/or modified sequence opt4 from Timigutuzumab_LightChain
  source 1..642: mol_type = other RNA

SEQ ID NO: 31650 - RNA, 1332 nt, synthetic construct; identical to SEQ ID NO: 30694
  misc_feature 1..1332: note = derived and/or modified sequence opt4 from Timolumab_HeavyChain
  source 1..1332: mol_type = other RNA

SEQ ID NO: 31651 - RNA, 642 nt, synthetic construct; identical to SEQ ID NO: 30695
  misc_feature 1..642: note = derived and/or modified sequence opt4 from Timolumab_LightChain
  source 1..642: mol_type = other RNA

SEQ ID NO: 31652 - RNA, 1347 nt, synthetic construct
  misc_feature 1..1347: note = derived and/or modified sequence opt4 from Tomuzotuximab_HeavyChain
  source 1..1347: mol_type = other RNA
caggtgcagctgaagcagagcggccccggcctggtgcagcccagccagagcctgagcatcacctgcaccgtgagcggcttcagcctgaccaactacggcgtgcactgggtgagacagagccccggcaagggcctggagtggctgggcgtgatctggagcggcggcaacaccgactacaacacccccttcaccagcagactgagcatcaacaaggacaacagcaagagccaggtgttcttcaagatgaacagcctgcagagcaacgacaccgccatctactactgcgccagagccctgacctactacgactacgagttcgcctactggggccagggcaccctggtgaccgtgagcaccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 31653 - RNA, 642 nt, synthetic construct; identical to SEQ ID NO: 30725
  misc_feature 1..642: note = derived and/or modified sequence opt4 from Tomuzotuximab_LightChain
  source 1..642: mol_type = other RNA

SEQ ID NO: 31654 - RNA, 1347 nt, synthetic construct; identical to SEQ ID NO: 31453
  misc_feature 1..1347: note = derived and/or modified sequence opt4 from Trastuzumab_duocarmazine_HeavyChain
  source 1..1347: mol_type = other RNA

SEQ ID NO: 31655 - RNA, 642 nt, synthetic construct; identical to SEQ ID NO: 31310
  misc_feature 1..642: note = derived and/or modified sequence opt4 from Trastuzumab_duocarmazine_LightChain
  source 1..642: mol_type = other RNA

SEQ ID NO: 31656 - RNA, 1368 nt, synthetic construct
  misc_feature 1..1368: note = derived and/or modified sequence opt4 from Varisacumab_HeavyChain
  source 1..1368: mol_type = other RNA
caggtgcagctggtgcagagcggcgccgaggtgaagaagcccggcgccagcgtgaaggtgagctgcaaggccagcggcggcaccttcagcagctacgccatcagctgggtgagacaggcccccggccagggcctggagtggatgggcggcttcgaccccgaggacggcgagaccatctacgcccagaagttccagggcagagtgaccatgaccgaggacaccagcaccgacaccgcctacatggagctgagcagcctgagaagcgaggacaccgccgtgtactactgcgccaccggcagaagcatggtgagaggcgtgatcatccccttcaacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31657 - RNA, 642 nt, synthetic construct
  misc_feature 1..642: note = derived and/or modified sequence opt4 from Varisacumab_LightChain
  source 1..642: mol_type = other RNA
gacatcagaatgacccagagccccagcagcctgagcgccagcgtgggcgacagagtgaccatcacctgcagagccagccagagcatcagcagctacctgaactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagctacagcacccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31658 - RNA, 1359 nt, synthetic construct
  misc_feature 1..1359: note = derived and/or modified sequence opt4 from Vunakizumab_HeavyChain
  source 1..1359: mol_type = other RNA
gaggtgcagctggtgcagagcggcgccgaggtgaagaagcccggcgccagcgtgaaggtgagctgcaaggccagcggctacaccttcaccgactacgaggtgcactgggtgagacaggcccccggccagggcctggagtggatgggcgtgatcgaccccggcaccggcggcgtggcctacaaccagaagttcgagggcagagtgaccatgaccgccgacaccagcaccagcaccgcctacatggagctgagaagcctgagaagcgacgacaccgccgtgtactactgcaccagatacagcctgttctacggcagcagcccctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31659 - RNA, 639 nt, synthetic construct
  misc_feature 1..639: note = derived and/or modified sequence opt4 from Vunakizumab_LightChain
  source 1..639: mol_type = other RNA
gagatcgtgctgacccagagccccgacttccagagcgtgacccccaaggagaaggtgaccatcacctgcagcgccagcagcagcgtgaactacatgcactggttccagcagaagcccgaccagagccccaagctgtggatctacagaaccagcaacctggccagcggcgtgcccagcagattcagcggcagcggcagcggcaccgactacaccctgaccatcaacagcctggaggccgaggacgccgccacctactactgccagcagagaagcagctacccctggaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31660 - RNA, 1341 nt, synthetic construct; identical to SEQ ID NO: 31563
  misc_feature 1..1341: note = derived and/or modified sequence opt4 from Xentuzumab_HeavyChain
  source 1..1341: mol_type = other RNA

SEQ ID NO: 31661 - RNA, 648 nt, synthetic construct; identical to SEQ ID NO: 31564
  misc_feature 1..648: note = derived and/or modified sequence opt4 from Xentuzumab_LightChain
  source 1..648: mol_type = other RNA

SEQ ID NO: 31662 - RNA, 726 nt, synthetic construct
  misc_feature 1..726: note = derived and/or modified sequence opt4 from anti-rabies_SO57_LightChain
  source 1..726: mol_type = other RNA
atgagcgtgcccaccatggcctgggccctgctgctgctgagcctgctgacccagggcaccggcagctgggcccagagcgccctgacccagcccagaagcgtgagcggcagccccggccagagcgtgaccatcagctgcaccggcaccagcagcgacatcggcggctacaacttcgtgagctggtaccagcagcaccccggcaaggcccccaagctgatgatctacgacgccaccaagagacccagcggcgtgcccgacagattcagcggcagcaagagcggcaacaccgccagcctgaccatcagcggcctgcaggccgaggacgaggccgactactactgctgcagctacgccggcgactacacccccggcgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31663 - RNA, 1428 nt, synthetic construct
  misc_feature 1..1428: note = derived and/or modified sequence opt4 from anti-rabies_SO57_HeavyChain
  source 1..1428: mol_type = other RNA
atggactggacctggagattcctgttcgtggtggccgccgccaccggcgtgcagagccaggtgcagctggtgcagagcggcgccgaggtgaagaagcccggcagcagcgtgaaggtgagctgcaaggccagcggcggcaccttcaacagatacaccgtgaactgggtgagacaggcccccggccagggcctggagtggatgggcggcatcatccccatcttcggcaccgccaactacgcccagagattccagggcagactgaccatcaccgccgacgagagcaccagcaccgcctacatggagctgagcagcctgagaagcgacgacaccgccgtgtacttctgcgccagagagaacctggacaacagcggcacctactactacttcagcggctggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31664 - RNA, 696 nt, synthetic construct
  misc_feature 1..696: note = derived and/or modified sequence opt4 from anti-rabies_SOJB_LightChain
  source 1..696: mol_type = other RNA
atggcctggaccgtgctgctgctgggcctgctgagccactgcaccggcagcgtgaccagctacgtgctgacccagccccccagcgtgagcgtggcccccggcaagaccgccagaatcaactgcggcggcaacaacatcgagtacagaagcgtgcactggtaccagcagaagagcggccaggcccccgtggccgtgatctacgacaacagcgacagacccagcggcatccccgagagattcagcggcagcaagagcggcaacaccgccaccctgaccatcagcagagtggaggccggcgacgaggccgactactactgccaggtgtgggacatcagcagcgacgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31665 - RNA, 1554 nt, synthetic construct
  misc_feature 1..1554: note = derived and/or modified sequence opt4 from anti-rabies_SOJB_HeavyChain
  source 1..1554: mol_type = other RNA
atggacaccctgtgcagcaccctgctgctgctgaccatccccagctgggtgctgagccagatcaccctgaaggagaccggccccaccctggtgaagcccacccagaccctgaccctgacctgcaccttcagcggcttcagcctgagcaccagcggcgtgggcgtgggctggatcagacagccccccggcaaggccctggagtgggtgaccctgatctactgggacgacgacaagagatacagccccagcctggagaacagagtgaccatcagaaaggacaccagcaagaaccaggtggccctgaccatgaccaacatggaccccctggacaccggcacctactactgcgcccacagacagcacatcagcagcttcccctggttcgacagctggggccagggcaccctggtgaccgtgagcagcgccagcaccaagggccccagcgtgttccccctggccccctgcagcagaagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacacctgcaacgtgaaccacaagcccagcaacaccaaggtggacaagagagtggagctgaagacccccctgggcgacaccacccacacctgccccagatgccccgagcccaagagctgcgacaccccccccccctgccccagatgccccgagcccaagagctgcgacaccccccccccctgccccagatgccccgagcccaagagctgcgacaccccccccccctgccccagatgccccgcccccgagctgctgggcggccccagcgtgttcctgttcccccccaagcccaaggacaccctgatgatcagcagaacccccgaggtgacctgcgtggtggtggacgtgagccacgaggaccccgaggtgcagttcaagtggtacgtggacggcgtggaggtgcacaacgccaagaccaagcccagagaggagcagttcaacagcaccttcagagtggtgagcgtgctgaccgtgctgcaccaggactggctgaacggcaaggagtacaagtgcaaggtgagcaacaaggccctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcagcggccagcccgagaacaactacaacaccaccccccccatgctggacagcgacggcagcttcttcctgtacagcaagctgaccgtggacaagagcagatggcagcagggcaacatcttcagctgcagcgtgatgcacgaggccctgcacaacagattcacccagaagagcctgagcctgagccccggcaag

SEQ ID NO: 31666 - RNA, 702 nt, synthetic construct
  misc_feature 1..702: note = derived and/or modified sequence opt4 from anti-rabies_SOJA_LightChain
  source 1..702: mol_type = other RNA
atggaggcccccgcccagctgctgttcctgctgctgctgtggctgcccgacaccaccggcgagatcgtgctgacccagagccccgccaccctgagcctgagccccggcgagagagccaccctggcctgcagagccagccagaccgccagcagatacctggcctggtaccagcagaagcccggccaggcccccagactgctgatctacgacaccagcaacagagccaccggcatccccgccagattcagcggcagcggcagcggcaccgacttcaccctgagcatcagcagcctggagcccgaggacttcgccgtgtactactgccagcagagattcaactggccctggaccttcggccagggcaccaaggtggagttcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31667 - RNA, 1422 nt, synthetic construct
  misc_feature 1..1422: note = derived and/or modified sequence opt4 from anti-rabies_SOJA_HeavyChain
  source 1..1422: mol_type = other RNA
atggagttcggcctgagctggctgttcctggtggccatcctgaagggcgtgcagtgcgaggtgcagctgctggagagcggcggcggcctggtgcagcccggcggcagcctgagactgagctgcgccgccagcggcttcaccttcagcaactacgccatgagctgggtgagacaggcccccggcaagggcctggagtgggtgagcgccatcagcgccagcggccacagcacctacctggccgacagcgtgaagggcagattcaccatcagcagagacaacagcaagaacaccctgtacctgcagatgaacagcctgagagccgaggacaccgccgtgtactactgcgccaaggacagagaggtgaccatgatcgtggtgctgaacggcggcttcgactactggggccagggcaccagagtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 31668 - RNA, 321 nt, synthetic construct
  misc_feature 1..321: note = derived and/or modified sequence opt4 from anti-rabies_LightChain
  source 1..321: mol_type = other RNA
gtgatgacccagagccccgccaccctgagcctgagccccggcgagagagccaccctgagctgcagagccagccagagcgtgagaaactacctggcctggtaccagcagaagcccggccaggcccccagactgctgatctacggcgccagcaacagagccaccggcatccccgccagattcagcggcagcggcagcggcaccgacttcaccctgaccatcagcagcctggagcccgaggacttcgccgtgtactactgccagcagagaagcgactggcccctgagcttcggccagggcaccaagctggagatcaagagaacc

SEQ ID NO: 31669 - RNA, 333 nt, synthetic construct
  misc_feature 1..333: note = derived and/or modified sequence opt4 from anti-rabies_HeavyChain
  source 1..333: mol_type = other RNA
ggccccgcctgggaggtgcccgagaccctgcccgtgcagcccctggacagccccagcgtggccatggcctgcaccggcgtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacagcaacagcggcagctactacgcccacgacctgggctactggggccagggcaccctggtgaccgtg

SEQ ID NO: 31670 - RNA, 342 nt, synthetic construct
  misc_feature 1..342: note = derived and/or modified sequence opt4 from anti-rabies_LightChain
  source 1..342: mol_type = other RNA
gagctggtgatgacccagagccccctgagcctgcccgtgaccctgggccagcccgccagcatcagctgcagaagcagccagagcctgatccacagcaacggcaacacctacctgaactggttccagcagagacccggccagagccccagaagactgatctacaaggtgagcgacagagacagcggcgtgcccgacagattcagcggcagcggcagcggcaccgacttcaccctgaagatcagcagagtggaggccgaggacgtgggcgtgtactactgcctgcagggcacccactggcccagaaccttcggccagggcaccaagctggagatcaagagaacc

SEQ ID NO: 31671 - RNA, 351 nt, synthetic construct
  misc_feature 1..351: note = derived and/or modified sequence opt4 from anti-rabies_HeavyChain
  source 1..351: mol_type = other RNA
gtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccagagacaaggccctggccgccagaagaggctactactactactacggcaccgacgtgtggggccagggcaccctggtgaccgtgagcagc

SEQ ID NO: 31672 - RNA, 648 nt, synthetic construct
  misc_feature 1..648: note = derived and/or modified sequence opt4 from anti-RSV_5ITB_LightChain
  source 1..648: mol_type = other RNA
agcgacatccagatgacccagagccccagcaccctgagcgccagcgtgggcgacagagtgaccatcacctgcagagccagccagagcatcagcagctggctggcctggtaccagcagaagcccggcaaggcccccaagctgctgatctacgacgccagcagcctggagagcggcgtgcccagcagattcagcggcagcggcagcggcaccgagttcaccctgaccatcagcagcctgcagcccgacgacttcgccacctactactgccagcagtacaacacctacagctggtggaccttcggccagggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31673 - RNA, 660 nt, synthetic construct
  misc_feature 1..660: note = derived and/or modified sequence opt4 from anti-RSV_5ITB_HeavyChain
  source 1..660: mol_type = other RNA
gtggagagcggcggcggcctgatccagcccggcggcagcctgagactgagctgcgccgtgagcggcttcaccgtgagcagcaagtacatgacctgggtgagacaggcccccggcaagggcctggagtgggtgagcgtgatctacggcggcggcagcacctactacgccgacagcgtggtgggcagattcaccatcagcagagacaacagcaagaacaccctgtacctgcagatgaacagcctgagagccgaggacaccgccgtgtactactgcgccagcagactgggcgtgagagccaccaccggcgacctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgc

SEQ ID NO: 31674 - RNA, 639 nt, synthetic construct; identical to SEQ ID NO: 31638
  misc_feature 1..639: note = derived and/or modified sequence opt4 from anti-alpha-toxin_4U6V_LightChain
  source 1..639: mol_type = other RNA

SEQ ID NO: 31675 - RNA, 675 nt, synthetic construct
  misc_feature 1..675: note = derived and/or modified sequence opt4 from anti-alpha-toxin_4U6V_HeavyChain
  source 1..675: mol_type = other RNA
gaggtgcagctggtggagagcggcggcggcctggtgcagcccggcggcagcctgagactgagctgcgccgccagcggcttcaccttcagcagccacgacatgcactgggtgagacaggccaccggcaagggcctggagtgggtgagcggcatcggcaccgccggcgacacctactaccccgacagcgtgaagggcagattcaccatcagcagagagaacgccaagaacagcctgtacctgcagatgaacagcctgagagccggcgacaccgccgtgtactactgcgccagagacagatacagccccaccggccactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgc

SEQ ID NO: 31676 - RNA, 879 nt, synthetic construct
  misc_feature 1..879: note = derived and/or modified sequence opt4 from anti-alpha-toxin_4U6V_Chain-A
  source 1..879: mol_type = other RNA
gccgacagcgacatcaacatcaagaccggcaccaccgacatcggcagcaacaccaccgtgaagaccggcgacctggtgacctacgacaaggagaacggcatgcacaagaaggtgttctacagcttcatcgacgacaagaaccacaacaagaagctgctggtgatcagaaccaagggcaccatcgccggccagtacagagtgtacagcgaggagggcgccaacaagagcggcctggcctggcccagcgccttcaaggtgcagctgcagctgcccgacaacgaggtggcccagatcagcgactactaccccagaaacagcatcgacaccaaggagtacatgagcaccctgacctacggcttcaacggcaacgtgaccggcgacgacaccggcaagatcggcggcctgatcggcgccaacgtgagcatcggccacaccctgaagtacgtgcagcccgacttcaagaccatcctggagagccccaccgacaagaaggtgggctggaaggtgatcttcaacaacatggtgaaccagaactggggcccctacgacagagacagctggaaccccgtgtacggcaaccagctgttcatgaagaccagaaacggcagcatgaaggccgccgacaacttcctggaccccaacaaggccagcagcctgctgagcagcggcttcagccccgacttcgccaccgtgatcaccatggacagaaaggccagcaagcagcagaccaacatcgacgtgatctacgagagagtgagagacgactaccagctgcactggaccagcaccaactggaagggcaccaacaccaaggacaagtggatcgacagaagcagcgagagatacaagatcgactgggagaaggaggagatgaccaac

SEQ ID NO: 31677 - RNA, 879 nt, synthetic construct; identical to SEQ ID NO: 31676
  misc_feature 1..879: note = derived and/or modified sequence opt4 from anti-alpha-toxin_4U6V_Chain-B
  source 1..879: mol_type = other RNA

SEQ ID NO: 31678 - RNA, 642 nt, synthetic construct
  misc_feature 1..642: note = derived and/or modified sequence opt4 from anti-IsdB_5D1Q_Chain-A
  source 1..642: mol_type = other RNA
gacatccagctgacccagagccccagcagcgtgagcgccagcgtgggcgacagaatcaccatcacctgcagagccagccaggacatcagcaactgggtggcctggtaccagcagaagcccggcaaggcccccaagctgctgatctacagcgccagcagcctgcagagcggcgtgcccagcagattcagcggcagcggcagcggcaccgacttcaccctgaccatcagcagcctgcagcccgaggacttcgccacctactactgccagcaggccaacaccttcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31679 - RNA, 783 nt, synthetic construct
  misc_feature 1..783: note = derived and/or modified sequence opt4 from anti-IsdB_5D1Q_Chain-B
  source 1..783: mol_type = other RNA
caggtgcagctggtgcagagcggcgccgaggtgaagaagcccgccagcagcgtgaaggtgagctgccaggccagcggcggcagcttcagcaccagaaccatcagctggctgagacaggcccccggccagggcctggagtggatgggcggcatcagccccatcttcggcgccgccaactacgcccagagattccagggcagagtgaccatcaccgccgacaagagcaccagcaccgcctacatggagctgaccagcctgaccagcgaggacaccgccgtgtactactgcgccagagacagaccccccggcgcccagttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcggcggcggcagcggccaccaccaccaccaccaccaccaccaccacggcggcgactacaaggaccacgacggcgactacaaggaccacgacatcgactacaaggacgacgacgacaag

SEQ ID NO: 31680 - RNA, 822 nt, synthetic construct
  misc_feature 1..822: note = derived and/or modified sequence opt4 from anti-IsdB_5D1Q_Chain-C
  source 1..822: mol_type = other RNA
gaggtgcagctggtggagagcggcggcggcctggtgcagcccggcggcagcctgaccctgagctgcgccgccagcggcctgatcttcagcgacagcaccatgcactgggtgagacaggccagcggcagaggcctggagtgggtggccagaatcagaagcaaggccaacaactacgccaccagcagcgacaagagcgccaccgcctacctggccagcgtgaagggcagattcaccatcagcagagacgacagcaaggacaccaccttcctggagatgagcagcctgaagatcgaggacaccgccgtgtactactgcatcgccagcagcaccaccggctggtacgtgagagaggacttcgactactggggccacggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcggcggcggcagcggccaccaccaccaccaccaccaccaccaccacggcggcgactacaaggaccacgacggcgactacaaggaccacgacatcgactacaaggacgacgacgacaag

SEQ ID NO: 31681 - RNA, 648 nt, synthetic construct
  misc_feature 1..648: note = derived and/or modified sequence opt4 from anti-IsdB_5D1Q_Chain-D
  source 1..648: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgagcatcagcagactggagcccgaggacttcgccgtgtactactgcctgcactacggcaccagccccatgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31682 - RNA, 360 nt, synthetic construct
  misc_feature 1..360: note = derived and/or modified sequence opt4 from anti-IsdB_5D1Q_Chain-E
  source 1..360: mol_type = other RNA
cccggcaagatgaccgacctgcaggacaccaagtacgtggtgtacgagagcgtggagaacaacgagagcatgatggacaccttcgtgaagcaccccatcaagaccggcatgctgaacggcaagaagtacatggtgatggagaccaccaacgacgactactggaaggacttcatggtggagggccagagagtgagaaccatcagcaaggacgccaagaacaacaccagaaccatcatcttcccctacgtggagggcaagaccctgtacgacgccatcgtgaaggtgcacgtgaagaccatcgactacgacggccagtaccacgtgagaatcgtggacaaggaggccttcaccaaggccaac

SEQ ID NO: 31683 - RNA, 657 nt, synthetic construct
  misc_feature 1..657: note = derived and/or modified sequence opt4 from anti-IsdB_5D1X_Chain-A
  source 1..657: mol_type = other RNA
gacatcgtgatgacccagagccccctgagcctgcccgtgaccctgggccagcccgccagcatcagctgcagcagcgcccagagcctggtgcacagcgacggcgacagctacctgacctggttccaccagagacccggccagagccccagaagactgatctacaaggtgagcatcagagacgccggcgtgcccgacagattcagcggcagcggcagcggcaccgacttcaccctgaagatcagcagagtggaggccgaggacgtgggcgtgtactactgcatgcaggccacccactggccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31684 - RNA, 777 nt, synthetic construct
  misc_feature 1..777: note = derived and/or modified sequence opt4 from anti-IsdB_5D1X_Chain-B
  source 1..777: mol_type = other RNA
caggtgcagctggtgcagagcggcagcgaggtgaagaagcccggcagcagcgtgaccctgagctgcaaggccagcggcgacaccttcaacacccacacctacagctgggtgagacaggcccccggccagagactggagtggatcggcggcatcatgcccatcttcgccgccagcaagagcgccccccacctgcaggacagactgaccatcaccgccaacaaggccaccagaaccgcctacatggagctgaccagcctgaccagcgacgacagcggcgtgtactactgcgccagagacggcagaggcgccctgcagtactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcggcggcggcagcggccaccaccaccaccaccaccaccaccaccacggcggcgactacaaggaccacgacggcgactacaaggaccacgacatcgactacaaggacgacgacgacaag

SEQ ID NO: 31685 - RNA, 822 nt, synthetic construct; identical to SEQ ID NO: 31680
  misc_feature 1..822: note = derived and/or modified sequence opt4 from anti-IsdB_5D1X_Chain-C
  source 1..822: mol_type = other RNA

SEQ ID NO: 31686 - RNA, 648 nt, synthetic construct
  misc_feature 1..648: note = derived and/or modified sequence opt4 from anti-IsdB_5D1X_Chain-D
  source 1..648: mol_type = other RNA
gagatcgtgctgacccagacccccgccaccctgagcctgacccccggcgagagagccaccctgacctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgagcatcagcagactggagcccgaggacttcgccgtgtactactgcctgcactacggcaccagccccatgtacttcttcggcagaggcaccgtgctggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31687 - RNA, 354 nt, synthetic construct
  misc_feature 1..354: note = derived and/or modified sequence opt4 from anti-IsdB_5D1X_Chain-E
  source 1..354: mol_type = other RNA
aagatgaccgacctgcaggacaccaagtacgtggtgtacgagagcgtggagaacaacgagagcatgatggacaccttcgtgaagcaccccatcaagaccggcatgctgaacggcaagaagtacatggtgatggagaccaccaacgacgactactggaaggacttcatggtggagggccagagagtgagaaccatcagcaaggacgccaagaacaacaccagaaccatcatcttcccctacgtggagggcaagaccctgtacgacgccatcgtgaaggtgcacgtgaagaccatcgactacgacggccagtaccacgtgagaatcgtggacaaggaggccttcaccaaggccaac

SEQ ID NO: 31688 - RNA, 792 nt, synthetic construct
  misc_feature 1..792: note = derived and/or modified sequence opt4 from anti-IsdB_5D1Z_Chain-B
  source 1..792: mol_type = other RNA
gccgaggtgcagctggtggagagcggcggcggcgtggtgcagcccggcggcagcctgagactgagctgcgccgccagcggcttcaccttcaacaagttctggatgaactgggtgagacaggcccccggcaagggcctggagtgggtggccgacatccaggtggacggcagcgagaagaactacgtggacagcgtgaagggcagattcaccatcagcagagacaacggcaagaacagcctgtacctgcagatgaacagcctgagagccgaggacaccggcgtgtactactgcgccagaggcagatacgactactggagcggctacctgagcccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcggcggcggcagcggccaccaccaccaccaccaccaccaccaccacggcggcgactacaaggaccacgacggcgactacaaggaccacgacatcgactacaaggacgacgacgacaag

SEQ ID NO: 31689 - RNA, 642 nt, synthetic construct
  misc_feature 1..642: note = derived and/or modified sequence opt4 from anti-IsdB_5D1Z_Chain-C
  source 1..642: mol_type = other RNA
gacatccagctgacccagagccccagcttcctgagcgccagcgtggccgacagagtgaccatcacctgcagagccagccaggccgtgagaagcagcctggcctggtaccagcagaagcccggcaaggccccccagctgctgatctacagcgccagcaccctggagaacggcgtgagcagcagattcagcggcagcggccccggcaccgagttcaccctgaccatcagcagcctgcagcccgaggacgtgggcacctactactgccagcagctgaacacctaccccttcaccttcggccccggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31690 - RNA, 810 nt, synthetic construct
  misc_feature 1..810: note = derived and/or modified sequence opt4 from anti-IsdB_5D1Z_Chain-D
  source 1..810: mol_type = other RNA
caggtgcagctgcaggagagcggccccggcctggtgaagcccagcgagaccctgagcctgatctgcaccgtgagcggcggcagcatcagcagcagcagctactactggggctggatcagacagacccccgagagaaacctggagtggatcggcatcatctacttcagcggcaccacctactacaaccccagcctgcagagcagagtgagcatgagcctggacagaagcaccaacagattcagcctgagactgagcagcgtgaccgccgccgacaccgccatctactactgcgccaagcccaagagcagagacagaggcggccccggcgacgactacttcggcatggacgtgtggggccagggcatcatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcggcggcggcagcggccaccaccaccaccaccaccaccaccaccacggcggcgactacaaggaccacgacggcgactacaaggaccacgacatcgactacaaggacgacgacgacaag

SEQ ID NO: 31691 - RNA, 810 nt, synthetic construct; identical to SEQ ID NO: 31690
  misc_feature 1..810: note = derived and/or modified sequence opt4 from anti-IsdB_5D1Z_Chain-F
  source 1..810: mol_type = other RNA

SEQ ID NO: 31692 - RNA, 792 nt, synthetic construct; identical to SEQ ID NO: 31688
  misc_feature 1..792: note = derived and/or modified sequence opt4 from anti-IsdB_5D1Z_Chain-G
  source 1..792: mol_type = other RNA

SEQ ID NO: 31693 - RNA, 642 nt, synthetic construct
  misc_feature 1..642: note = derived and/or modified sequence opt4 from anti-IsdB_5D1Z_HeavyChain
  source 1..642: mol_type = other RNA
gacatccagatgacccagagccccagcttcctgagcgccagcgtgggcgacagagtgaccatcacctgcagagccagccagggcatcaccacctacctgggctggtaccagcagagacccggcaaggccccccagctgctgatctacgccgccagcagcctgcagagcggcgtgccccccagattcagcggcagcggcagcggcaccgagttcaccctgaccatcagcagcctgcagcccgaggacttcgccacctactactgccagcagctgaacacctacccctacaccttcggccccggcaccagactggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31694 - RNA, 471 nt, synthetic construct
  misc_feature 1..471: note = derived and/or modified sequence opt4 from anti-IsdB_5D1Z_Chain-I
  source 1..471: mol_type = other RNA
ggccccgccaaggccaccaacaacacctaccccatcctgaaccaggagctgagagaggccatcaagaaccccgccatcaaggacaaggaccacagcgcccccaacagcagacccatcgacttcgagatgaagaagaaggacggcacccagcagttctaccactacgccagcagcgtgaagcccgccagagtgatcttcaccgacagcaagcccgagatcgagctgggcctgcagagcggccagttctggagaaagttcgaggtgtacgagggcgacaagaagctgcccatcaagctggtgagctacgacaccgtgaaggactacgcctacatcagattcagcgtgagcaacggcaccaaggccgtgaagatcgtgagcagcacccacttcaacaacaaggaggagaagtacgactacaccctgatggagttcgcccagcccatctacaacagcgccgacaagttcaagacc

SEQ ID NO: 31695 - RNA, 324 nt, synthetic construct
  misc_feature 1..324: note = derived and/or modified sequence opt4 from anti-HIV_b12_LightChain
  source 1..324: mol_type = other RNA
gagatcgtgctgacccagagccccggcaccctgagcctgagccccggcgagagagccaccttcagctgcagaagcagccacagcatcagaagcagaagagtggcctggtaccagcacaagcccggccaggcccccagactggtgatccacggcgtgagcaacagagccagcggcatcagcgacagattcagcggcagcggcagcggcaccgacttcaccctgaccatcaccagagtggagcccgaggacttcgccctgtactactgccaggtgtacggcgccagcagctacaccttcggccagggcaccaagctggagagaaag

SEQ ID NO: 31696 - RNA, 381 nt, synthetic construct
  misc_feature 1..381: note = derived and/or modified sequence opt4 from anti-HIV_b12_HeavyChain
  source 1..381: mol_type = other RNA
caggtgcagctggagcagagcggcgccgaggtgaagaagcccggcgccagcgtgaaggtgagctgccaggccagcggctacagattcagccacttcaccgtgcactgggtgagacaggcccccggccagagattcgagtggatgggctggatcaacccctacaacggcaacaaggagttcagcgccaagttccaggacagagtgaccttcaccgccgacaccagcgccaacaccgcctacatggagctgagaagcctgagaagcgccgacaccgccgtgtactactgcgccagagtgggcgagtggggctgggacgacagcccctacgacaactactacatggacgtgtggggcaagggcaccaccgtgatcgtgagcagc

SEQ ID NO: 31697 - RNA, 633 nt, synthetic construct
  misc_feature 1..633: note = derived and/or modified sequence opt4 from anti-HIV_2G12_LightChain
  source 1..633: mol_type = other RNA
gtggtgatgacccagagccccagcaccctgagcgccagcgtgggcgacaccatcaccatcacctgcagagccagccagagcatcgagacctggctggcctggtaccagcagaagcccggcaaggcccccaagctgctgatctacaaggccagcaccctgaagaccggcgtgcccagcagattcagcggcagcggcagcggcaccgagttcaccctgaccatcagcggcctgcagttcgacgacttcgccacctaccactgccagcactacgccggctacagcgccaccttcggccagggcaccagagtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggc

SEQ ID NO: 31698 - RNA, 672 nt, synthetic construct
  misc_feature 1..672: note = derived and/or modified sequence opt4 from anti-HIV_2G12_HeavyChain
  source 1..672: mol_type = other RNA
gaggtgcagctggtggagagcggcggcggcctggtgaaggccggcggcagcctgatcctgagctgcggcgtgagcaacttcagaatcagcgcccacaccatgaactgggtgagaagagtgcccggcggcggcctggagtgggtggccagcatcagcaccagcagcacctacagagactacgccgacgccgtgaagggcagattcaccgtgagcagagacgacctggaggacttcgtgtacctgcagatgcacaagatgagagtggaggacaccgccatctactactgcgccagaaagggcagcgacagactgagcgacaacgaccccttcgacgcctggggccccggcaccgtggtgaccgtgagccccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 31699 - RNA, 642 nt, synthetic construct
  misc_feature 1..642: note = derived and/or modified sequence opt4 from anti-HIV_4E10_LightChain
  source 1..642: mol_type = other RNA
gagatcgtgctgacccagagccccggcacccagagcctgagccccggcgagagagccaccctgagctgcagagccagccagagcgtgggcaacaacaagctggcctggtaccagcagagacccggccaggcccccagactgctgatctacggcgccagcagcagacccagcggcgtggccgacagattcagcggcagcggcagcggcaccgacttcaccctgaccatcagcagactggagcccgaggacttcgccgtgtactactgccagcagtacggccagagcctgagcaccttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgag

SEQ ID NO: 31700 - RNA, 684 nt, synthetic construct
  misc_feature 1..684: note = derived and/or modified sequence opt4 from anti-HIV_4E10_HeavyChain
  source 1..684: mol_type = other RNA
caggtgcagctggtgcagagcggcgccgaggtgaagagacccggcagcagcgtgaccgtgagctgcaaggccagcggcggcagcttcagcacctacgccctgagctgggtgagacaggcccccggcagaggcctggagtggatgggcggcgtgatccccctgctgaccatcaccaactacgcccccagattccagggcagaatcaccatcaccgccgacagaagcaccagcaccgcctacctggagctgaacagcctgagacccgaggacaccgccgtgtactactgcgccagagagggcaccaccggctggggctggctgggcaagcccatcggcgccttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 31701 - RNA, 312 nt, synthetic construct
  misc_feature 1..312: note = derived and/or modified sequence opt4 from anti-HIV_VRC01_LightChain
  source 1..312: mol_type = other RNA
gagatcgtgctgacccagagccccggcaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggccccgactacaacctgaccatcagcaacctggagagcggcgacttcggcgtgtactactgccagcagtacgagttcttcggccagggcaccaaggtgcaggtggacatcaagaga

SEQ ID NO: 31702 - RNA, 363 nt, synthetic construct
  misc_feature 1..363: note = derived and/or modified sequence opt4 from anti-HIV_VRC01_HeavyChain
  source 1..363: mol_type = other RNA
caggtgcagctggtgcagagcggcggccagatgaagaagcccggcgagagcatgagaatcagctgcagagccagcggctacgagttcatcgactgcaccctgaactggatcagactggcccccggcaagagacccgagtggatgggctggctgaagcccagaggcggcgccgtgaactacgccagacccctgcagggcagagtgaccatgaccagagacgtgtacagcgacaccgccttcctggagctgagaagcctgaccgtggacgacaccgccgtgtacttctgcaccagaggcaagaactgcgactacaactgggacttcgagcactggggcagaggcacccccgtgatcgtgagcagc

SEQ ID NO: 31703 - RNA, 330 nt, synthetic construct
  misc_feature 1..330: note = derived and/or modified sequence opt4 from anti-HIV_PG9_LightChain
  source 1..330: mol_type = other RNA
cagagcgccctgacccagcccgccagcgtgagcggcagccccggccagagcatcaccatcagctgcaacggcaccagcaacgacgtgggcggctacgagagcgtgagctggtaccagcagcaccccggcaaggcccccaaggtggtgatctacgacgtgagcaagagacccagcggcgtgagcaacagattcagcggcagcaagagcggcaacaccgccagcctgaccatcagcggcctgcaggccgaggacgagggcgactactactgcaagagcctgaccagcaccagaagaagagtgttcggcaccggcaccaagctgaccgtgctg

SEQ ID NO: 31704 - RNA, 408 nt, synthetic construct
  misc_feature 1..408: note = derived and/or modified sequence opt4 from anti-HIV_PG9_HeavyChain
  source 1..408: mol_type = other RNA
cagagactggtggagagcggcggcggcgtggtgcagcccggcagcagcctgagactgagctgcgccgccagcggcttcgacttcagcagacagggcatgcactgggtgagacaggcccccggccagggcctggagtgggtggccttcatcaagtacgacggcagcgagaagtaccacgccgacagcgtgtggggcagactgagcatcagcagagacaacagcaaggacaccctgtacctgcagatgaacagcctgagagtggaggacaccgccacctacttctgcgtgagagaggccggcggccccgactacagaaacggctacaactactacgacttctacgacggctactacaactaccactacatggacgtgtggggcaagggcaccaccgtgaccgtgagcagc

SEQ ID NO: 31705 - RNA, 630 nt, synthetic construct
  misc_feature 1..630: note = derived and/or modified sequence opt4 from anti-HIV_VRC07_LightChain
  source 1..630: mol_type = other RNA
gagatcgtgctgacccagagccccggcaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggccccgactacaccctgaccatcagcaacctggagagcggcgacttcggcgtgtactactgccagcagtacgagttcttcggccagggcaccaaggtgcaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagaagccccgtgaccaagagcttcaacagaggcgagtgc

SEQ ID NO: 31706 - RNA, 375 nt, synthetic construct
  misc_feature 1..375: note = derived and/or modified sequence opt4 from anti-HIV_VRC07_HeavyChain
  source 1..375: mol_type = other RNA
caggtgcagctggtgcagagcggcggccagatgaagaagcccggcgagagcatgagaatcagctgcagagccagcggctacgagttcatcgactgcaccctgaactggatcagactggcccccggcaagagacccgagtggatgggctggctgaagcccagaggcggcgccgtgaactacgccagacccctgcagggcagagtgaccatgaccagagacgtgtacagcgacaccgccttcctggagctgagaagcctgaccagcgacgacaccgccgtgtacttctgcaccagaggcaagtactgcaccgccagagactactacaactgggacttcgagcactggggccagggcacccccgtgatcgtgagcagc

SEQ ID NO: 31707 - RNA, 315 nt, synthetic construct
  misc_feature 1..315: note = derived and/or modified sequence opt4 from anti-HIV_3BNC117_LightChain
  source 1..315: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgtggtgcccggcaccagactggacctgaagagaaccgtggccgccccc

SEQ ID NO: 31708 - RNA, 387 nt, synthetic construct
  misc_feature 1..387: note = derived and/or modified sequence opt4 from anti-HIV_3BNC117_HeavyChain
  source 1..387: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagcgccagcaccaagggcccc

SEQ ID NO: 31709 - RNA, 324 nt, synthetic construct
  misc_feature 1..324: note = derived and/or modified sequence opt4 from anti-HIV_10-1074_LightChain
  source 1..324: mol_type = other RNA
agctacgtgagacccctgagcgtggccctgggcgagaccgccagaatcagctgcggcagacaggccctgggcagcagagccgtgcagtggtaccagcacagacccggccaggcccccatcctgctgatctacaacaaccaggacagacccagcggcatccccgagagattcagcggcacccccgacatcaacttcggcaccagagccaccctgaccatcagcggcgtggaggccggcgacgaggccgactactactgccacatgtgggacagcagaagcggcttcagctggagcttcggcggcgccaccagactgaccgtgctg

SEQ ID NO: 31710 - RNA, 396 nt, synthetic construct
  misc_feature 1..396: note = derived and/or modified sequence opt4 from anti-HIV_10-1074_HeavyChain
  source 1..396: mol_type = other RNA
caggtgcagctgcaggagagcggccccggcctggtgaagcccagcgagaccctgagcgtgacctgcagcgtgagcggcgacagcatgaacaactactactggacctggatcagacagagccccggcaagggcctggagtggatcggctacatcagcgacagagagagcgccacctacaaccccagcctgaacagcagagtggtgatcagcagagacaccagcaagaaccagctgagcctgaagctgaacagcgtgacccccgccgacaccgccgtgtactactgcgccaccgccagaagaggccagagaatctacggcgtggtgagcttcggcgagttcttctactactacagcatggacgtgtggggcaagggcaccaccgtgaccgtgagcagc

SEQ ID NO: 31711 - RNA, 633 nt, synthetic construct
  misc_feature 1..633: note = derived and/or modified sequence opt4 from anti-HIV_PGT121_LightChain
  source 1..633: mol_type = other RNA
agcgacatcagcgtggcccccggcgagaccgccagaatcagctgcggcgagaagagcctgggcagcagagccgtgcagtggtaccagcacagagccggccaggcccccagcctgatcatctacaacaaccaggacagacccagcggcatccccgagagattcagcggcagccccgacagccccttcggcaccaccgccaccctgaccatcaccagcgtggaggccggcgacgaggccgactactactgccacatctgggacagcagagtgcccaccaagtgggtgttcggcggcggcaccaccctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 31712 - RNA, 705 nt, synthetic construct
  misc_feature 1..705: note = derived and/or modified sequence opt4 from anti-HIV_PGT121_HeavyChain
  source 1..705: mol_type = other RNA
cagatgcagctgcaggagagcggccccggcctggtgaagcccagcgagaccctgagcctgacctgcagcgtgagcggcgccagcatcagcgacagctactggagctggatcagaagaagccccggcaagggcctggagtggatcggctacgtgcacaagagcggcgacaccaactacagccccagcctgaagagcagagtgaacctgagcctggacaccagcaagaaccaggtgagcctgagcctggtggccgccaccgccgccgacagcggcaagtactactgcgccagaaccctgcacggcagaagaatctacggcatcgtggccttcaacgagtggttcacctacttctacatggacgtgtggggcaacggcacccaggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgc

SEQ ID NO: 31713 - RNA, 657 nt, synthetic construct
  misc_feature 1..657: note = derived and/or modified sequence opt4 from anti-HIV_PGDM1400_LightChain
  source 1..657: mol_type = other RNA
gacttcgtgctgacccagagcccccacagcctgagcgtgacccccggcgagagcgccagcatcagctgcaagagcagccacagcctgatccacggcgacagaaacaactacctggcctggtacgtgcagaagcccggcagaagcccccagctgctgatctacctggccagcagcagagccagcggcgtgcccgacagattcagcggcagcggcagcgacaaggacttcaccctgaagatcagcagagtggagaccgaggacgtgggcacctactactgcatgcagggcagagagagcccctggaccttcggccagggcaccaaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31714 - RNA, 735 nt, synthetic construct
  misc_feature 1..735: note = derived and/or modified sequence opt4 from anti-HIV_PGDM1400_HeavyChain
  source 1..735: mol_type = other RNA
caggcccagctggtgcagagcggccccgaggtgagaaagcccggcaccagcgtgaaggtgagctgcaaggcccccggcaacaccctgaagacctacgacctgcactgggtgagaagcgtgcccggccagggcctgcagtggatgggctggatcagccacgagggcgacaagaaggtgatcgtggagagattcaaggccaaggtgaccatcgactgggacagaagcaccaacaccgcctacctgcagctgagcggcctgaccagcggcgacaccgccgtgtactactgcgccaagggcagcaagcacagactgagagactacgccctgtacgacgacgacggcgccctgaactgggccgtggacgtggactacctgagcaacctggagttctggggccagggcaccgccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgac

SEQ ID NO: 31715 - RNA, 630 nt, synthetic construct
  misc_feature 1..630: note = derived and/or modified sequence opt4 from anti-HIV_N6_LightChain
  source 1..630: mol_type = other RNA
tacatccacgtgacccagagccccagcagcctgagcgtgagcatcggcgacagagtgaccatcaactgccagaccagccagggcgtgggcagcgacctgcactggtaccagcacaagcccggcagagcccccaagctgctgatccaccacaccagcagcgtggaggacggcgtgcccagcagattcagcggcagcggcttccacaccagcttcaacctgaccatcagcgacctgcaggccgacgacatcgccacctactactgccaggtgctgcagttcttcggcagaggcagcagactgcacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31716 - RNA, 675 nt, synthetic construct
  misc_feature 1..675: note = derived and/or modified sequence opt4 from anti-HIV_N6_HeavyChain
  source 1..675: mol_type = other RNA
agagcccacctggtgcagagcggcaccgccatgaagaagcccggcgccagcgtgagagtgagctgccagaccagcggctacaccttcaccgcccacatcctgttctggttcagacaggcccccggcagaggcctggagtgggtgggctggatcaagccccagtacggcgccgtgaacttcggcggcggcttcagagacagagtgaccctgaccagagacgtgtacagagagatcgcctacatggacatcagaggcctgaagcccgacgacaccgccgtgtactactgcgccagagacagaagctacggcgacagcagctgggccctggacgcctggggccagggcaccaccgtggtggtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31717 - RNA, 1080 nt, synthetic construct
  misc_feature 1..1080: note = derived and/or modified sequence opt4 from anti-HIV_N6_GChain
  source 1..1080: mol_type = other RNA
gcctgggaggacgccgacaccaccctgttctgcgccagcgacgccaaggcctacagcaccgagaagcacaacgtgtgggccacccacgcctgcgtgcccaccgaccccgacccccaggagatccccctggagaacgtgaccgagaacttcaacatgtggaagaacaacatggtggagcagatgcacgaggacatcatcagcctgtgggacgagagcctgaagccctgcgtgatgctgaccggcggcagcaccatcaagcaggcctgccccaaggtgaccttcgagcccatccccatccactactgcgcccccgccggcttcgccatcctgaagtgcagagacgaggacttcaacggcaccggcccctgcaagaacgtgagcaccgtgcagtgcacccacggcatcaagcccgtggtgagcacccagctgctgctgaacggcagcctggccaagggcgacatcgtgatcagaagcgagaacctgaccaacaacgccaaggtgatcatcgtgcagctgaacgagcccgtgcagatcgtgtgcatcagacccaacaacggcggcagcggcagcggcggcgacatcagacaggcccactgcaacgtgaccagaggcaagtgggtgaacatcaccaagaacgtgaaggagcagctgtggaagatcttcaacaagaccaccaacatcaccttcaacaacaccatcttcaacagccccgccggcggcgacctggagatcaccacccacagcttcaactgcggcggcgagttcttctactgcaacaccagcgacctgttcaacgagaccaacctgagcgccaaccacaccgacaccaacgagaacatcaccctgcagtgcagaatcaagcagatcgtgagaatgtggcagagagtgggccaggccatgtacgccccccccatcgccggcaacatcacctgcatcagcaacatcaccggcctgctgctgaccagagacggcgtgaacgacacccacgacaaggagaacgagaccttcagacccaccggcggcgacatgagagacaactggagaagcgagctgtacaagtacaaggtgatcaagctgaag

SEQ ID NO: 31718 - RNA, 645 nt, synthetic construct
  misc_feature 1..645: note = derived and/or modified sequence opt4 from anti-HIV_10E8_LightChain
  source 1..645: mol_type = other RNA
agctacgagctgacccaggagaccggcgtgagcgtggccctgggcagaaccgtgaccatcacctgcagaggcgacagcctgagaagccactacgccagctggtaccagaagaagcccggccaggcccccatcctgctgttctacggcaagaacaacagacccagcggcgtgcccgacagattcagcggcagcgccagcggcaacagagccagcctgaccatcagcggcgcccaggccgaggacgacgccgagtactactgcagcagcagagacaagagcggcagcagactgagcgtgttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31719 - RNA, 708 nt, synthetic construct
  misc_feature 1..708: note = derived and/or modified sequence opt4 from anti-HIV_10E8_HeavyChain
  source 1..708: mol_type = other RNA
gaggtgcagctggtggagagcggcggcggcctggtgaagcccggcggcagcctgagactgagctgcagcgccagcggcttcgacttcgacaacgcctggatgacctgggtgagacagccccccggcaagggcctggagtgggtgggcagaatcaccggccccggcgagggctggagcgtggactacgccgcccccgtggagggcagattcaccatcagcagactgaacagcatcaacttcctgtacctggagatgaacaacctgagaatggaggacagcggcctgtacttctgcgccagaaccggcaagtactacgacttctggagcggctacccccccggcgaggagtacttccaggactggggcagaggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaag

SEQ ID NO: 31720 - RNA, 333 nt, synthetic construct
  misc_feature 1..333: note = derived and/or modified sequence opt4 from anti-HIV_12A12_LightChain
  source 1..333: mol_type = other RNA
gacatccagatgacccagagccccagcagcctgagcgccagcgtgggcgacagagtgaccatcacctgccaggccggccagggcatcggcagcagcctgcagtggtaccagcagaagcccggcaaggcccccaagctgctggtgcacggcgccagcaacctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggagatcaagagaaccgtggccgcccccagcgtg

SEQ ID NO: 31721 - RNA, 381 nt, synthetic construct
  misc_feature 1..381: note = derived and/or modified sequence opt4 from anti-HIV_12A12_HeavyChain
  source 1..381: mol_type = other RNA
agccagcacctggtgcagagcggcacccaggtgaagaagcccggcgccagcgtgagaatcagctgccaggccagcggctacagcttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgccttcatggacctgagcggcctgagaagcgacgacaccgccctgtacttctgcgccagagacggcagcggcgacgacaccagctggcacctggacccctggggccagggcaccctggtgatcgtgagcgccgccagcaccaagggc

SEQ ID NO: 31722 - RNA, 315 nt, synthetic construct
  misc_feature 1..315: note = derived and/or modified sequence opt4 from anti-HIV_12A21_LightChain
  source 1..315: mol_type = other RNA
gacatccagatgacccagagccccagcagcctgagcgccagcgtgggcgacagagtgaccatcaactgccaggccggccagggcatcggcagcagcctgaactggtaccagaagaagcccggcagagcccccaagctgctggtgcacggcgccagcaacctgcagagaggcgtgcccagcagattcagcggcagcggcttccacaccaccttcaccctgaccatcagcagcctgcagcccgacgacgtggccacctacttctgcgccgtgttccagtggttcggccccggcaccaaggtggacatcaagagaacc

SEQ ID NO: 31723 - RNA, 384 nt, synthetic construct
  misc_feature 1..384: note = derived and/or modified sequence opt4 from anti-HIV_12A21_HeavyChain
  source 1..384: mol_type = other RNA
agccagcacctggtgcagagcggcacccaggtgaagaagcccggcgccagcgtgagagtgagctgccaggccagcggctacaccttcaccaactacatcctgcactggtggagacaggcccccggccagggcctggagtggatgggcctgatcaagcccgtgttcggcgccgtgaactacgccagacagttccagggcagaatccagctgaccagagacatctacagagagatcgccttcctggacctgagcggcctgagaagcgacgacaccgccgtgtactactgcgccagagacgagagcggcgacgacctgaagtggcacctgcacccctggggccagggcacccaggtgatcgtgagccccgccagcaccaagggcccc

SEQ ID NO: 31724 - RNA, 648 nt, synthetic construct
  misc_feature 1..648: note = derived and/or modified sequence opt4 from anti-HIV_35022_LightChain
  source 1..648: mol_type = other RNA
cagagcgtgctgacccagagcgccagcgtgagcggcagcctgggccagagcgtgaccatcagctgcaccggccccaacagcgtgtgctgcagccacaagagcatcagctggtaccagtggccccccggcagagcccccaccctgatcatctacgaggacaacgagagagcccccggcatcagccccagattcagcggctacaagagctactggagcgcctacctgaccatcagcgacctgagacccgaggacgagaccacctactactgctgcagctacacccacaacagcggctgcgtgttcggcaccggcaccaaggtgagcgtgctgggccagagcaaggccaaccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31725 - RNA, 729 nt, synthetic construct
  misc_feature 1..729: note = derived and/or modified sequence opt4 from anti-HIV_35022_HeavyChain
  source 1..729: mol_type = other RNA
gagggccagctggtgcagagcggcgccgagctgaagaagcccggcgccagcgtgaagatcagctgcaagaccagcggctacagattcaacttctaccacatcaactggatcagacagaccgccggcagaggccccgagtggatgggctggatcagcccctacagcggcgacaagaacctggcccccgccttccaggacagagtgatcatgaccaccgacaccgaggtgcccgtgaccagcttcaccagcaccggcgccgcctacatggagatcagaaacctgaagttcgacgacaccggcacctacttctgcgccaagggcctgctgagagacggcagcagcacctggctgccctacctgtggggccagggcaccctgctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagggcctggaggtgctgttccag

SEQ ID NO: 31726 - RNA, 648 nt, synthetic construct
  misc_feature 1..648: note = derived and/or modified sequence opt4 from anti-HIV_3BC176_LightChain
  source 1..648: mol_type = other RNA
cagagcgtgctgacccagcccgccagcgtgagcgccagccccggccagagcatcaccgtgagctgcaccggcagcagaaacgacgtgggcggctacgacttcgtgagctggtaccagagacaccccggcggcgtgcccaagctgatcatctacgagatcagcaagagacccagcggcatcccccagagattcagcggcagcagaagcggcaacaccgccagcctgaccatcagcggcctgcaggacgacgacgaggccgactactactgctgcagctacgccagctacgacagactgatcttcggcggcggcaccagagtgagcgtgctgagacagcccaaggccgcccccagcgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31727 - RNA, 699 nt, synthetic construct
  misc_feature 1..699: note = derived and/or modified sequence opt4 from anti-HIV_3BC176_HeavyChain
  source 1..699: mol_type = other RNA
gagcaggtgcagctgatgcagagcggcgcccagctgagagaccccggcgacagcctgaagatcagctgcaaggccagcggctacaacttcatcgactaccacatccactgggtgagactggcccccggcagaggcctggagtggatgggctggatcgaccccgtgggcggcatcaccaagtacgccggccagttccagggcagactgagcctgaccagagacaccagcaccaacaccctgttcctggagctgagcagactgaccgccggcgacaccgccgtgtacttctgcgccagaagcatgagacccgtggaccacggcatcgactacagcggcctgttcgtgttccacttctggggcagaggcagcgacgtgctggtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgac

SEQ ID NO: 31728 - RNA, 621 nt, synthetic construct
  misc_feature 1..621: note = derived and/or modified sequence opt4 from anti-HIV_3BNC55_LightChain
  source 1..621: mol_type = other RNA
gacatccagatgacccagagccccagcagcctgagcgccagcgtgggcgacaaggtgaccatcacctgccagaccagcgccggctacctgaactggtaccagcagagaagaggcagagcccccaagctgctgatgtacgacggcagcagactggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31729 - RNA, 675 nt, synthetic construct
  misc_feature 1..675: note = derived and/or modified sequence opt4 from anti-HIV_3BNC55_HeavyChain
  source 1..675: mol_type = other RNA
caggtgcagctggtgcagagcggcaccgccgtgaagagacccggcgccagcgtgagagtgagctgccaggccagcggctacaccttcaccgactacttcatctactggtggagacaggcccccggccagggcctggagtggctgggctggatcaaccccctgaccagccagcccagctaccccagcagattccagggcagactgaccctgaccagagacaccttcgacgagatgctgtacatggacctgagaggcctgagaagcgacgacaccggcatctacttctgcgccagaagacacagcgactactgcgacttcgacatctggggcagcggcacccagatcatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacc

SEQ ID NO: 31730 - RNA, 618 nt, synthetic construct
  misc_feature 1..618: note = derived and/or modified sequence opt4 from anti-HIV_3BNC60_LightChain
  source 1..618: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagagaggcgtgcccgccagattcagcggcagaagatggggccaggagtacaacctgaccatcaacaacctgcagcccgaggacgtggccacctacttctgccaggtgtacgagttcatcgtgcccggcaccagactggacctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31731 - RNA, 687 nt, synthetic construct
  misc_feature 1..687: note = derived and/or modified sequence opt4 from anti-HIV_3BNC60_HeavyChain
  source 1..687: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagagtgagcctgaccagacaggccagctgggacttcgacacctacagcttctacatggacctgaaggccgtgagaagcgacgacaccgccatctacttctgcgccagacagagaagcgacttctgggacttcgacgtgtggggcagcggcacccaggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacc

SEQ ID NO: 31732 - RNA, 687 nt, synthetic construct
  misc_feature 1..687: note = derived and/or modified sequence opt4 from anti-HIV_3BNC60_HeavyChain
  source 1..687: mol_type = other RNA
gaggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaacgccagacagttccagggcagagtgagcctgaccagacaggccagctgggacttcgacacctacagcttctacatggacctgaaggccgtgagaagcgacgacaccgccatctacttctgcgccagacagagaagcgacttctgggacttcgacgtgtggggcagcggcacccaggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacc

SEQ ID NO: 31733 - RNA, 648 nt, synthetic construct
  misc_feature 1..648: note = derived and/or modified sequence opt4 from anti-HIV_447-52D_LightChain
  source 1..648: mol_type = other RNA
cagagcgtgctgacccagccccccagcgtgagcgccgcccccggccagaaggtgaccatcagctgcagcggcagcagcagcaacatcggcaacaactacgtgctgtggtaccagcagttccccggcaccgcccccaagctgctgatctacggcaacaacaagagacccagcggcatccccgacagattcagcggcagcaagagcggcaccagcgccaccctgggcatcaccggcctgcagaccggcgacgaggccgactacttctgcgccacctgggacagcggcctgagcgccgactgggtgttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgc

SEQ ID NO: 31734 - RNA, 693 nt, synthetic construct
  misc_feature 1..693: note = derived and/or modified sequence opt4 from anti-HIV_447-52D_HeavyChain
  source 1..693: mol_type = other RNA
gaggtgcagctggtggagagcggcggcggcctggtgaagcccggcggcagcctgagactgacctgcgtggccagcggcttcaccttcagcgacgtgtggctgaactgggtgagacaggcccccggcaagggcctggagtgggtgggcagaatcaagagcagaaccgacggcggcaccaccgactacgccgccagcgtgaagggcagattcaccatcagcagagacgacagcaagaacaccctgtacctgcagatgaacagcctgaagaccgaggacaccgccgtgtacagctgcaccaccgacggcttcatcatgatcagaggcgtgagcgaggactactactactactacatggacgtgtggggcaagggcaccaccgtgaccgtgagcagcgccagcaccaagggccccagcgtgttccccctggccccctgcagcagaagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacacctgcaacgtgaaccacaagcccagcaacaccaaggtggacaagagagtggagctg

SEQ ID NO: 31735 - RNA, 645 nt, synthetic construct
  misc_feature 1..645: note = derived and/or modified sequence opt4 from anti-HIV_447-52D_LightChain
  source 1..645: mol_type = other RNA
cagagcgtgctgacccagccccccagcgtgagcgccgcccccggccagaaggtgaccatcagctgcagcggcagcagcagcaacatcggcaacaactacgtgctgtggtaccagcagttccccggcaccgcccccaagctgctgatctacggcaacaacaagagacccagcggcatccccgacagattcagcggcagcaagagcggcaccagcgccaccctgggcatcaccggcctgcagaccggcgacgaggccgactacttctgcgccacctgggacagcggcctgagcgccgactgggtgttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgag

SEQ ID NO: 31736 - RNA, 705 nt, synthetic construct
  misc_feature 1..705: note = derived and/or modified sequence opt4 from anti-HIV_447-52D_HeavyChain
  source 1..705: mol_type = other RNA
gaggtgcagctggtggagagcggcggcggcctggtgaagcccggcggcagcctgagactgacctgcgtggccagcggcttcaccttcagcgacgtgtggctgaactgggtgagacaggcccccggcaagggcctggagtgggtgggcagaatcaagagcagaaccgacggcggcaccaccgactacgccgccagcgtgaagggcagattcaccatcagcagagacgacagcaagaacaccctgtacctgcagatgaacagcctgaagaccgaggacaccgccgtgtacagctgcaccaccgacggcttcatcatgatcagaggcgtgagcgaggactactactactactacatggacgtgtggggcaagggcaccaccgtgaccgtgagcagcgccagcaccaagggccccagcgtgttccccctggccccctgcagcagaagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacacctgcaacgtgaaccacaagcccagcaacaccaaggtggacaagagagtggagctgaagacccccacc

SEQ ID NO: 31737 - RNA, 624 nt, synthetic construct
  misc_feature 1..624: note = derived and/or modified sequence opt4 from anti-HIV_5H/I1-BMV-D5_LightChain
  source 1..624: mol_type = other RNA
gacatccagatgacccagagccccagcaccctgagcgccagcatcggcgacagagtgaccatcacctgcagagccagcgagggcatctaccactggctggcctggtaccagcagaagcccggcaaggcccccaagctgctgatctacaaggccagcagcctggccagcggcgcccccagcagattcagcggcagcggcagcggcaccgacttcaccctgaccatcagcagcctgcagcccgacgacttcgccacctactactgccagcagtacagcaactaccccctgaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagc

SEQ ID NO: 31738 - RNA, 651 nt, synthetic construct
  misc_feature 1..651: note = derived and/or modified sequence opt4 from anti-HIV_5H/I1-BMV-D5_HeavyChain
  source 1..651: mol_type = other RNA
caggtgcagctggtgcagagcggcgccgaggtgagaaagcccggcgccagcgtgaaggtgagctgcaaggccagcggcgacaccttcagcagctacgccatcagctgggtgagacaggcccccggccagggcctggagtggatgggcggcatcatccccatcttcggcaccgccaactacgcccaggccttccagggcagagtgaccatcaccgccaacgagagcaccagcaccgcctacatggagctgagcagcctgagaagcgaggacaccgccatctactactgcgccagagacaaccccaccctgctgggcagcgactactggggcgccggcaccctggtgaccgtgagcagcgccagcaccaagggccccagcgtgttccccctggccccctgcagcagaagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtg

SEQ ID NO: 31739 - RNA, 657 nt, synthetic construct
  misc_feature 1..657: note = derived and/or modified sequence opt4 from anti-HIV_5H/I1-BMV-D5_A-Chain
  source 1..657: mol_type = other RNA
atgcagctgctgagcggcatcgtgcagcagcagaacaacctgctgagagccatcgaggcccagcagcacctgctgcagctgaccgtgtggggcatcaagcagctgcaggccagaatcctggccggcggcagcggcggccacaccacctggatggagtgggacagagagatcaacaactacaccagcctgatccacagcctgatcgaggagagccagaaccagcaggagaagaacgagcaggagctgctggagggcagcagcggcggccagctgctgagcggcatcgtgcagcagcagaacaacctgctgagagccatcgaggcccagcagcacctgctgcagctgaccgtgtggggcatcaagcagctgcaggccagaatcctggccggcggcagcggcggccacaccacctggatggagtgggacagagagatcaacaactacaccagcctgatccacagcctgatcgaggagagccagaaccagcaggagaagaacgagcaggagctgctggagggcagcagcggcggccagctgctgagcggcatcgtgcagcagcagaacaacctgctgagagccatcgaggcccagcagcacctgctgcagctgaccgtgtggggcatcaagcagctgcaggccagaatcctggccggcggc

SEQ ID NO: 31740 - RNA, 390 nt, synthetic construct
  misc_feature 1..390: note = derived and/or modified sequence opt4 from anti-HIV_8ANC195_LightChain
  source 1..390: mol_type = other RNA
gacatccagatgacccagagccccagcaccctgagcgccagcatcggcgacaccgtgagaatcagctgcagagccagccagagcatcaccggcaactgggtggcctggtaccagcagagacccggcaaggcccccagactgctgatctacagaggcgccgccctgctgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttcatcttcccccccagcgacgagcagctgaagagcggcacc

SEQ ID NO: 31741 - RNA, 423 nt, synthetic construct
  misc_feature 1..423: note = derived and/or modified sequence opt4 from anti-HIV_8ANC195_HeavyChain
  source 1..423: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgacaagtggagcggcctgcaccacgacggcgtgatggccttcagcagctggggccagggcaccctgatcagcgtgagcgccgccagcaccaagggccccagcgtgttc

SEQ ID NO: 31742 - RNA, 333 nt, synthetic construct
  misc_feature 1..333: note = derived and/or modified sequence opt4 from anti-HIV_CAP256-VRC26.01_LightChain
  source 1..333: mol_type = other RNA
cagagcgtgctgacccagccccccagcgtgagcgccgcccccggccagaaggtgaccatcagctgcagcggcagcagcagcaccatcggcaacaactacgtgagctggtacagactgctgcccggcaccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 31743 - RNA, 432 nt, synthetic construct
  misc_feature 1..432: note = derived and/or modified sequence opt4 from anti-HIV_CAP256-VRC26.01_HeavyChain
  source 1..432: mol_type = other RNA
gaggtgcaggtggtggagagcggcggcggcgtggtgcagcccggcagaagcctgagactgagctgcaccgccagcggcttcaccttcagcaacttcgccatgggctgggtgagacaggcccccggcaagggcctggagtgggtggccttcatcagcagcgacggcagcaacaagaactacggcgacagcgtgaagggcagattcaccatcagcagagacaacagcaagaacaccgtgttcctgcagatgaacagcctgagagtggaggacaccgccctgtactactgcgccaaggacgtgggcgactacaagagcgacgagtggggcaccgagtactacgacatcagcatcagctaccccatccaggaccccagagccatggtgggcgccttcgacctgtggggccagggcaccatggtgaccgtgagcccc

SEQ ID NO: 31744 - RNA, 324 nt, synthetic construct
  misc_feature 1..324: note = derived and/or modified sequence opt4 from anti-HIV_CAP256-VRC26.02_LightChain
  source 1..324: mol_type = other RNA
cagagcgtgctgacccagccccccagcgtgagcgccgcccccggccagaaggtgaccatcagctgcagcggcagcaacagcaacatcggcaacaaggacgtgagctggtaccagcagatccccgccaccgcccccaagctgctgatctacgagaacaacaagagacccagcggcatcagcgacagattcagcggcagcaagagcggcaccagcgccaccctggccatcaccggcctgcagaccggcgacgaggccgactactactgcgccacctgggacggcagagtgagcgtgatcggcaccggcaccaacgtgatcgtgctg

SEQ ID NO: 31745 - RNA, 432 nt, synthetic construct
  misc_feature 1..432: note = derived and/or modified sequence opt4 from anti-HIV_CAP256-VRC26.02_HeavyChain
  source 1..432: mol_type = other RNA
gaggtgcagctggtggagagcggcggcggcgtggtgcagcccggcagaagcctgagactgagctgcgccgccagccagttcagcttcggcaactacggcatgcactgggtgagacaggcccccggcaagggcctggagtgggtggccgccatcagcttcgccggcaccaagaccaactacgccgacagcgtgaagggcagattcaccatcagcagagacaacagcaagaacaccgtgtacctgcagatgaacagcctgagagccgaggacaccgccctgtacttctgcgccaaggacatcagagagtacgagtgcgagtactggaccagcgactactacgacttcggcagaccccagccctgcatcgacagcagaggcgtggtgggcaccttcgacgtgtggggccagggcaccatggtgaccgtgagcagc

SEQ ID NO: 31746 - RNA, 333 nt, synthetic construct
  misc_feature 1..333: note = derived and/or modified sequence opt4 from anti-HIV_CAP256-VRC26.03_LightChain
  source 1..333: mol_type = other RNA
cagagcgtgctgacccagccccccagcgtgagcgccgcccccggccagaaggtgaccatcagctgcagcggcagcagcagcaacatcggcaacaacttcgtgagctggtaccagcagagacccggcaccgcccccaagatcctgatctacgagaacaacaagagacccagcgagacccccgacagattcagcggcagcaagagcggcaccagcgccaccctggccatcaccggcctgcagaccgccgacgaggccgagtactactgcgccacctggagcgccagcctgagcagcgccagagtgttcggcaccggcaccagaatcaccgtgctg

SEQ ID NO: 31747 - RNA, 432 nt, synthetic construct
  misc_feature 1..432: note = derived and/or modified sequence opt4 from anti-HIV_CAP256-VRC26.03_HeavyChain
  source 1..432: mol_type = other RNA
gaggtgcagctggtggagagcggcggcggcgtggtgcagcccggcaagagcctgagactgagctgcgccgccagcagattcagcttcaacagatacggcatgcactgggtgagacaggcccccggcaagggcctggagtgggtggccgccatcagctacgacggcaccgacaagtaccacgccgacaaggtgtggggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcaagcagctgccctgcagaaagagcagaggcgtggccggcatcttcgacggctggggccagggcaccatggtgaccgtgagcagc

SEQ ID NO: 31748 - RNA, 333 nt, synthetic construct
  misc_feature 1..333: note = derived and/or modified sequence opt4 from anti-HIV_CAP256-VRC26.04_LightChain
  source 1..333: mol_type = other RNA
cagcccgtgctgacccagccccccagcgtgagcgccgcccccggccagaaggtgaccatcagctgcagcggcagcagcagcaacatcggcaacaacttcgtgagctggtaccagcagagacccggcaccgcccccagcctgctgatctacgagaccaacaagagacccagcggcatccccgacagattcagcggcagcaagagcgccaccagcgccaccctggccatcaccggcctgcagaccggcgacgaggccgactactactgcgccacctgggccgccagcctgaccagcgccagagtgttcggcaccggcaccaaggtgatcgtgagc

SEQ ID NO: 31749 - RNA, 432 nt, synthetic construct
  misc_feature 1..432: note = derived and/or modified sequence opt4 from anti-HIV_CAP256-VRC26.04_HeavyChain
  source 1..432: mol_type = other RNA
gaggtgcagctggtggagagcggcggcggcgtggtgcagcccggcaagagcctgagactgagctgcgccgccagccagttcagcttcaacagatacggcatgcactgggtgagacaggcccccggcaagggcctggagtgggtggccgccatcagctacgacggcaccgacaagtaccacgccgacaaggtgtggggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcaagcagctgccctgcagaaagagcagaggcgtggccggcatcttcgacaagtggggccagggcaccatggtgatcgtgagcagc

SEQ ID NO: 31750 - RNA, 324 nt, synthetic construct
  misc_feature 1..324: note = derived and/or modified sequence opt4 from anti-HIV_CAP256-VRC26.05_LightChain
  source 1..324: mol_type = other RNA
cagagcgccctgacccagccccccagcgtgagcgccgcccccggccagaaggtgaccatcagctgcagcggcaacatcggcaacaactacgtgagctggtaccagcaggtgcccggcaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctggggcggcagcctgagaaccggcggcgtgctgggcaccggcaccagagtgaccgtgctg

SEQ ID NO: 31751 - RNA, 432 nt, synthetic construct
  misc_feature 1..432: note = derived and/or modified sequence opt4 from anti-HIV_CAP256-VRC26.05_HeavyChain
  source 1..432: mol_type = other RNA
gaggtgcagctggtggagagcggcggcggcgtggtgcagcccggcagaagcctgagactgagctgcgccgccagccacttcagcctgagcagctacggcatgcactgggtgagacaggcccccggcaagggcctggagtgggtgaccggcatcagcttcgccggcaccaagacctactacggcgacagcgtgagaggcagattcaccgtgagcagagacatcagcaagaacaccctgttcctgcagatgaacagcctgagacccgacgacaccgccatgtactactgcgccagagaccagagatactacgagtgcgaggagtgggccagcgactactacgacttcggcagagagcagccctgcctggaccccagaggcgtggtgggcatcttcgacctgtggggccagggcaccatggtgaccgtgagcagc

SEQ ID NO: 31752 - RNA, 324 nt, synthetic construct
  misc_feature 1..324: note = derived and/or modified sequence opt4 from anti-HIV_CAP256-VRC26.06_LightChain
  source 1..324: mol_type = other RNA
cagagcgtgctgacccagccccccagcgtgagcgccgcccccggccagaaggtgaccatcagctgcagcggcagcaccagcaagatcggccagaacagcgtgagctggtaccagcagctgcccggcaccgcccccaagctgctgatctacgagaacgacagaagacccagcggcacccccgacagattcagcggcagcaagagcggcaccagcgccaccctggccatcaccggcctgcagaccggcgacgaggccgagtactactgcgagacctgggacggcagcggcggcgtgttcggcaccggcaccaaggtgaccgtgctg

SEQ ID NO: 31753 - RNA, 435 nt, synthetic construct
  misc_feature 1..435: note = derived and/or modified sequence opt4 from anti-HIV_CAP256-VRC26.06_HeavyChain
  source 1..435: mol_type = other RNA
gaggtgcagctgatcgagagcggcggcggcgtggtgcagcccggcagaagcctgagactgagctgcggcgccagcggcttcagcttcaacaactacggcatgcactgggtgagacaggcccccggcaagggcctggagtgggtggccggcatcagcttcgccggcatcaagaagtactacggcaccagcgtgaagggcagattcaccatcagcagagacaacagcaagaacaacttctacctgcagatgaacagcctgagagtggaggacaccgccctgtactactgcgccagagacctgagagagctggagtgcgaggagtggaccctgtacaactactacgacttcggcagcagaggcccctgcgtggaccccagaggcgtggccggcagcttcgacgtgtggggccagggcaccatggtgaccgtgagcagc

SEQ ID NO: 31754 - RNA, 333 nt, synthetic construct
  misc_feature 1..333: note = derived and/or modified sequence opt4 from anti-HIV_CAP256-VRC26.07_LightChain
  source 1..333: mol_type = other RNA
caggccgtgctgacccagccccccagcgtgagcgccgcccccggccagaacgtgaccatcagctgcagcggcagcggcagcaacatcggcaacaacttcgtgagctggtaccagcagagacccggcaccgcccccaagctgctgatctacgagagcaacaagagacccagcggcatccccgacagattcagcggcagcaagagcggcaccagcgccaccctggccatcaccggcctgcagaccggcgacgaggcctactactactgcgccacctgggccgccagactgaacagcgccagagtgttcggcaccggcaccatggtgaccgtgctg

SEQ ID NO: 31755 - RNA, 432 nt, synthetic construct
  misc_feature 1..432: note = derived and/or modified sequence opt4 from anti-HIV_CAP256-VRC26.07_HeavyChain
  source 1..432: mol_type = other RNA
gaggtgcagctggtggagagcggcggcggcgtggtgcagcccggcagaagcctgagactgagctgcgtgggcagccagttcagcttcaacagatacggcatgcactgggtgagacaggcccccggcaagggcctggagtgggtggccggcatcagcttcgacggcaccgacagataccacgccgacaacgtgtggggcagattcaccatcagcagagacaacagcaagaacaccctgtacctgcagatgagcagcctgagagccgaggacaccgccctgtactactgcgccaaggacctgagagaggacgagtgcgaggagtggtggagcgactactacgacttcggcaagaagctgccctgcagaaagagcagaggcgtggccggcgtgttcgacaagtggggccagggcaccatggtgaccgtgagcagc

SEQ ID NO: 31756 - RNA, 333 nt, synthetic construct
  misc_feature 1..333: note = derived and/or modified sequence opt4 from anti-HIV_CAP256-VRC26.08_LightChain
  source 1..333: mol_type = other RNA
cagagcgccctgacccagccccccagcgtgagcgccgcccccggccagaaggtgaccatcagctgcagcggcaacagcagcaacatcggcaacaacttcgtgagctggtaccagcaggtgcccggcaccgcccccaagctgctgctgtacgagacctacagaagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 31757 - RNA, 438 nt, synthetic construct
  misc_feature 1..438: note = derived and/or modified sequence opt4 from anti-HIV_CAP256-VRC26.08_HeavyChain
  source 1..438: mol_type = other RNA
gaggtgcagctggtggagagcggcggcggcgtggtgcagcccggcagaagcctgaccctgagctgcgccgccagccagttcaccttcagcaactacggcatgcactgggtgagacaggcccccggcaagggcctggagtgggtggccagcgtgagcaacgacggcaccaagaagtaccacggcgacagcgtgtggggcagattcaccatcagcagagacaacagcaagaacaccctgttcctgcagatgagcagcctgagagccgaggacaccgccgtgtacttctgcgtgagagaccagagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 31758 - RNA, 333 nt, synthetic construct
  misc_feature 1..333: note = derived and/or modified sequence opt4 from anti-HIV_CAP256-VRC26.09_LightChain
  source 1..333: mol_type = other RNA
cagagcgccctgacccagccccccagcgtgagcgccgcccccggccagaaggtgaccatcagctgcagcggcaacagcagcaacatcggcaacaacttcgtgagctggtaccagcagctgcccggcaccgcccccaagctgctgatctacgagaacaacagaagacccagcggcatccccgacagattcagcggcagcaagagcggcaccagcgccaccctggccatcagcggcctgcagaccggcgacgaggccgactactggtgcgccgtgtggggcgtgagaagaggcgccggcgccgtgttcggcgccggcaccaaggtgaccgtgctg

SEQ ID NO: 31759 - RNA, 438 nt, synthetic construct
  misc_feature 1..438: note = derived and/or modified sequence opt4 from anti-HIV_CAP256-VRC26.09_HeavyChain
  source 1..438: mol_type = other RNA
gaggtgcagctggtggagagcggcggcggcgtggtgcagcccggcagaagcctgaccctgagctgcgccgccagccagttcaacttcgccaactacggcatgcactgggtgagacaggcccccggcaagggcctggagtgggtggccagcatcagcaacgacggcaccaagaagtaccacgaggagagcgtgtggggcagattcaccatcagcaaggacaacagcaagagcaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 31760 - RNA, 333 nt, synthetic construct
  misc_feature 1..333: note = derived and/or modified sequence opt4 from anti-HIV_CAP256-VRC26.10_LightChain
  source 1..333: mol_type = other RNA
cagagcgtgctgacccagccccccagcgtgagcgccgcccccggccagaaggtgaccatcagctgcagcggcagcagcagcaacatcggcgacaactacgtgagctggtaccagcacctgcccggcaccgcccccaagctgctgatctacgagaacaccagaagacccagcggcatccccgacagattcagcggcagcaagagcggcaccagcgccaccctggccatcaccggcctgcagaccggcgacgaggccgactactactgcggcacctgggacgtgagacccaacagaggcgccgtgttcggcaccggcaccaaggtgaccgtgctg

SEQ ID NO: 31761 - RNA, 432 nt, synthetic construct
  misc_feature 1..432: note = derived and/or modified sequence opt4 from anti-HIV_CAP256-VRC26.10_HeavyChain
  source 1..432: mol_type = other RNA
caggccatcctggtggagagcggcggcggcgtggtgcagcccggcagaagcctgagactgagctgcgccgccagccagttcaccttcagcggccacggcctgcactgggtgagacaggcccccggcaagggcctggagtgggtggccagcatcagcttcgccggcaccaagatggactacgccgacagcgtgaagggcagattcgccatcagcagagacaacagcaagaacaccctgtacctgcagatgaacagcctgagagtggaggacaccgccctgtactactgcgccaaggacatgagagagtacgagtgcgagtactggaccagcgactactacgacttcggcagaccccagccctgcatcgacagaagaggcgtggtgggcatcttcgacatgtggggccagggcaccatggtgaccgtgagcacc

SEQ ID NO: 31762 - RNA, 321 nt, synthetic construct
  misc_feature 1..321: note = derived and/or modified sequence opt4 from anti-HIV_CAP256-VRC26.11_LightChain
  source 1..321: mol_type = other RNA
cagagcgtgctgacccagccccccagcgtgagcgccgcccccggccagaacgtgaccatcagctgcagcggcccccccagccacatcgagaagaacgacgtgagctggtaccagagactgcccggcatggcccccaagatggtgatctacgagagcaagagaagacccctgggcatccccgtgagattcagcgccagcagaagcggcagcagcgccaccctggtgatcaccggcctgcagaccgccgacgaggccgactactactgcggcacctgggacggcagaatgaacttcggcaccggcaccaccgtgagcgtgctg

SEQ ID NO: 31763 - RNA, 429 nt, synthetic construct
  misc_feature 1..429: note = derived and/or modified sequence opt4 from anti-HIV_CAP256-VRC26.11_HeavyChain
  source 1..429: mol_type = other RNA
gaggtgcagctggtggagagcggcggcggcgtggtgccccccggcaagagcctgaccctgagctgcgtggccagcagattcaccttcagcgccttcggcatgcactgggtgagacaggcccccggcaagggcctggagtgggtggccagcatcagcttcgccggcatcaagaagtactacgccgacagcgtgaagggcagattcagcatcagcagagacaacagcaacaccctgttcctgcagatgaacggcctgagaggcgaggacaccggcctgtaccactgcgtgaaggacatgagagagctggagtgcgaggagtgggccagcgactactacgacttcggcaagccccagccctgcctggacagaagaggcgtgagcggcatcagcgcctggtggggccccggcaccatggtgaccgtgagcagc

SEQ ID NO: 31764 - RNA, 321 nt, synthetic construct
  misc_feature 1..321: note = derived and/or modified sequence opt4 from anti-HIV_CAP256-VRC26.12_LightChain
  source 1..321: mol_type = other RNA
cagagcgtgctgacccagccccccagcgtgagcaccgcccccggccagaccgtgaccgtgagctgcagcggcggcaccagcaacaccggcaacaacttcgtgagctggtaccagcacctgcccggcaccgcccccaagctgctgatctacgagaacaacaagagacccctgggcgtgcccgacagattcagcggcgccaagagcggcaccagcgccaccctggccatcaccggcctgcagaccggcgacgagggcgactactactgcgccacctggagcggcagcctgaacatcggcaccggcaccaaggtgagcgtgctg

SEQ ID NO: 31765 - RNA, 432 nt, synthetic construct
  misc_feature 1..432: note = derived and/or modified sequence opt4 from anti-HIV_CAP256-VRC26.12_HeavyChain
  source 1..432: mol_type = other RNA
gaggtgcagctggtgcagagcggcggcggcgtggtgcagcccggcagaagcctgagactgagctgcgccgccccctacttcgagttcggcagatacggcttccactgggtgagacaggcccccggcaagggcctggagtgggtggccagcatcagcttcgccggcagagactactaccacagccccagcgtgtggggcagattcaccatcagcagagacaacagcaagaacaccctgtacctgcagatgaacagcctgagaatcgaggacaccgccctgtacttctgcgccagagacctgagagagagcgagtgcgaggagtgggagagcgactactacgacttcggcaagaagggcccctgcgtgaagcccagaggcgtggccggcggcctggacctgtggggccagggcaccatggtgatcgtgagcagc

SEQ ID NO: 31766 - RNA, 333 nt, synthetic construct
  misc_feature 1..333: note = derived and/or modified sequence opt4 from anti-HIV_CAP256-VRC26.I1_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 31767 - RNA, 432 nt, synthetic construct
  misc_feature 1..432: note = derived and/or modified sequence opt4 from anti-HIV_CAP256-VRC26.I1_HeavyChain
  source 1..432: mol_type = other RNA
caggtgcagctggtggagagcggcggcggcgtggtgcagcccggcagaagcctgagactgagctgcgccgccagcggcttcaccttcagcaactacgccatggactgggtgagacaggcccccggcaagggcctggagtgggtggccgtgatcagcagcgacggcagcaacaagaactacgccgacagcgtgaagggcagattcaccatcagcagagacaacagcaagaacaccctgtacctgcagatgaacagcctgagagccgaggacaccgccgtgtactactgcgccaaggacctgggcgagaacaagaacgacgagtgggccaccgactactacgacctgagcatcgcctaccccgtgcaggaccccagagccgtggtgggcgccttcgacatctggggccagggcaccatggtgaccgtgagcagc

SEQ ID NO: 31768 - RNA, 333 nt, synthetic construct
  misc_feature 1..333: note = derived and/or modified sequence opt4 from anti-HIV_CAP256-VRC26.I2_LightChain
  source 1..333: mol_type = other RNA
cagagcgtgctgacccagccccccagcgtgagcgccgcccccggccagaaggtgaccatcagctgcagcggcagcagcagcaccatcggcaacaactacgtgagctggtaccagctgctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 31769 - RNA, 432 nt, synthetic construct
  misc_feature 1..432: note = derived and/or modified sequence opt4 from anti-HIV_CAP256-VRC26.I2_HeavyChain
  source 1..432: mol_type = other RNA
caggtgcagctggtggagagcggcggcggcgtggtgcagcccggcagaagcctgagactgagctgcgccgccagcggcttcaccttcagcaacttcgccatgggctgggtgagacaggcccccggcaagggcctggagtgggtggccttcatcagcagcgacggcagcaacaagaactacggcgacagcgtgaagggcagattcaccatcagcagagacaacagcaagaacaccctgttcctgcagatgaacagcctgagagccgaggacaccgccctgtactactgcgccaaggacgtgggcgagtacaagagcgacgagtgggccaccgactactacgacctgagcatcgcctaccccatccaggaccccagagccatggtgggcgccttcgacatctggggccagggcaccatggtgaccgtgagcagc

SEQ ID NO: 31770 - RNA, 333 nt, synthetic construct
  misc_feature 1..333: note = derived and/or modified sequence opt4 from anti-HIV_CAP256-VRC26.UCA_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 31771 - RNA, 432 nt, synthetic construct
  misc_feature 1..432: note = derived and/or modified sequence opt4 from anti-HIV_CAP256-VRC26.UCA_HeavyChain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcatcggctaccccggccaggaccccagaggcgtggtgggcgccttcgacatctggggccagggcaccatggtgaccgtgagcagc

SEQ ID NO: 31772 - RNA, 324 nt, synthetic construct
  misc_feature 1..324: note = derived and/or modified sequence opt4 from anti-HIV_CH01_LightChain
  source 1..324: mol_type = other RNA
gagatcgtgctggcccagagccccggcaccctgagcctgagccccggcgagagagccaccctgagctgcagagccagccacaacgtgcaccccaagtacttcgcctggtaccagcagaagcccggccagagccccagactgctgatctacggcggcagcaccagagccgccggcatccccggcaagttcagcggcagcggcagcggcaccgacttcaccctgaccatcagcagagtggaccccgaggacttcgccgtgtactactgccagcagtacggcggcagcccctacaccttcggccagggcaccaaggtggagatcaag

SEQ ID NO: 31773 - RNA, 399 nt, synthetic construct
  misc_feature 1..399: note = derived and/or modified sequence opt4 from anti-HIV_CH01_HeavyChain
  source 1..399: mol_type = other RNA
gaggtgcagctggtggagagcggcgccaacgtggtgagacccggcggcagcctgagactgagctgcaaggccagcggcttcatcttcgagaacttcggcttcagctgggtgagacaggcccccggcaagggcctgcagtgggtggccggcctgaactggaacggcggcgacaccagatacgccgacagcgtgaagggcagattcagaatgagcagagacaacagcagaaacttcgtgtacctggacatggacaaggtgggcgtggacgacaccgccttctactactgcgccagaggcaccgactacaccatcgacgacgccggcatccactaccagggcagcggcaccttctggtacttcgacctgtggggcagaggcaccctggtgagcgtgagcagc

SEQ ID NO: 31774 - RNA, 324 nt, synthetic construct
  misc_feature 1..324: note = derived and/or modified sequence opt4 from anti-HIV_CH02_LightChain
  source 1..324: mol_type = other RNA
gagatcgtgctgacccagagccccgccaccctgagcgtgagccccggcgagagagccaccctgagctgcagagccagccagaacgtgcaccccagatacttcgcctggtaccagcagaagagaggccagagccccagactgctgatccacagcggcagcaccagagccgccggcatcgccgacagattcagcggcggcggcagcggcatgcacttcaccctgaccatcaccagagtggagcccgaggacttcgccgtgtacttctgccagcagtacggcggcagcccctacaccttcggccagggcaccagagtggagctgaga

SEQ ID NO: 31775 - RNA, 399 nt, synthetic construct
  misc_feature 1..399: note = derived and/or modified sequence opt4 from anti-HIV_CH02_HeavyChain
  source 1..399: mol_type = other RNA
gaggtgcagctggtggagagcggcggcagcgtggtgagacccggcggcagcctgagactgagctgcagagccagcggcttcatcttcgagaactacggcctgacctgggtgagacaggtgcccggcaagggcctgcactgggtgagcggcatgaactggaacggcggcgacaccagatacgccgacagcgtgagaggcagattcagcatgagcagagacaacagcaacaacatcgcctacctgcagatgaacaacctgagagtggaggacaccgccctgtactactgcgccagaggcaccgactacaccatcgacgaccagggcagattctaccagggcagcggcaccttctggtacttcgacttctggggcagaggcaccctggtgaccgtgagcagc

SEQ ID NO: 31776 - RNA, 324 nt, synthetic construct
  misc_feature 1..324: note = derived and/or modified sequence opt4 from anti-HIV_CH03_LightChain
  source 1..324: mol_type = other RNA
gagatcgtgctgacccagagccccgccaccctgagcctgagccccggcgagagagccaccctgagctgcagagccagccagagcgtgcaccccaagtacttcgcctggtaccagcagaagcccggccagagccccagactgctgatctacagcggcagcaccagagccgccggcatcgccgacagattcagcggcggcggcagcggcatccacttcaccctgaccatcaccagagtggagcccgaggacttcgccgtgtacttctgccagcagtacggcggcagcccctacaccttcggccagggcaccaaggtggagctgaga

SEQ ID NO: 31777 - RNA, 399 nt, synthetic construct
  misc_feature 1..399: note = derived and/or modified sequence opt4 from anti-HIV_CH03_HeavyChain
  source 1..399: mol_type = other RNA
gaggtgcagctggtggagagcggcggcggcgtggtgagacccggcggcagcctgagactgagctgcgccgccagcggcttcatcttcgagaactacggcctgacctgggtgagacaggtgcccggcaagggcctgcactgggtgagcggcatgaactggaacggcggcgacaccagatacgccgacagcgtgagaggcagattcagcatgagcagagacaacagcaacaacatcgcctacctgcagatgaagaacctgagagtggacgacaccgccctgtactactgcgccagaggcaccgactacaccatcgacgaccagggcatcttctacaagggcagcggcaccttctggtacttcgacctgtggggcagaggcaccctggtgaccgtgagcagc

SEQ ID NO: 31778 - RNA, 324 nt, synthetic construct
  misc_feature 1..324: note = derived and/or modified sequence opt4 from anti-HIV_CH04_LightChain
  source 1..324: mol_type = other RNA
gagatcgtgctgacccagagccccgacaccctgagcctgagccccggcgagagagccaccctgagctgcagagccagccagagcgtgcacagcagatacttcgcctggtaccagcacaagcccggccagccccccagactgctgatctacggcggcagcaccagagccaccggcatccccaacagattcagcgccggcggcagcggcacccagttcaccctgaccgtgaacagactggaggccgaggacttcgccgtgtactactgccagcagtacggcagaagcccctacaccttcggccagggcaccaaggtggagatcaga

SEQ ID NO: 31779 - RNA, 399 nt, synthetic construct
  misc_feature 1..399: note = derived and/or modified sequence opt4 from anti-HIV_CH04_HeavyChain
  source 1..399: mol_type = other RNA
gaggtgcagctggtggagagcggcggcggcctgatcagacccggcggcagcctgagactgagctgcaagggcagcggcttcatcttcgagaacttcggcttcggctgggtgagacagggccccggcaagggcctggagtgggtgagcggcaccaactggaacggcggcgacagcagatacggcgacagcgtgaagggcagattcaccatcagcagagacaacagcaacaacttcgtgtacctgcagatgaacagcctgagacccgaggacaccgccatctactactgcgccagaggcaccgactacaccatcgacgaccagggcatcagataccagggcagcggcaccttctggtacttcgacgtgtggggcagaggcaccctggtgaccgtgagcagc

SEQ ID NO: 31780 - RNA, 627 nt, synthetic construct
  misc_feature 1..627: note = derived and/or modified sequence opt4 from anti-HIV_CH103_LightChain
  source 1..627: mol_type = other RNA
tacgagctgacccagccccccagcgtgagcgtgagccccggccagaccgccaccatcacctgcagcggcgccagcaccaacgtgtgctggtaccaggtgaagcccggccagagccccgaggtggtgatcttcgagaactacaagagacccagcggcatccccgacagattcagcggcagcaagagcggcagcaccgccaccctgaccatcagaggcacccaggccatcgacgaggccgactactactgccaggtgtgggacagcttcagcaccttcgtgttcggcagcggcacccaggtgaccgtgctgagacagcccaaggccaaccccaccgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31781 - RNA, 678 nt, synthetic construct
  misc_feature 1..678: note = derived and/or modified sequence opt4 from anti-HIV_CH103_HeavyChain
  source 1..678: mol_type = other RNA
caggtgcagctgcaggagagcggccccggcgtggtgaagagcagcgagaccctgagcctgacctgcaccgtgagcggcggcagcatgggcggcacctactggagctggctgagactgagccccggcaagggcctggagtggatcggctacatcttccacaccggcgagaccaactacagccccagcctgaagggcagagtgagcatcagcgtggacaccagcgaggaccagttcagcctgagactgagaagcgtgaccgccgccgacaccgccgtgtacttctgcgccagcctgcccagaggccagctggtgaacgcctacttcagaaactggggcagaggcagcctggtgagcgtgaccgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaag

SEQ ID NO: 31782 - RNA, 321 nt, synthetic construct
  misc_feature 1..321: note = derived and/or modified sequence opt4 from anti-HIV_M66.6_LightChain
  source 1..321: mol_type = other RNA
gacatccagctgacccagagccccagcagcctgagcgccagcgtgggcgacagagtgaccatcacctgcagagccagccagagcatcggcagctacctgaactggtaccagcagaagcccggcaaggcccccaagctgctgatctacgccgccagcaccctgcagagcggcgtgcccagcagattcagcggcagcggcagcggcaccgacttcaccctgaccatcagcagcctgcagcccgaggacagcgccacctactactgccagcagagctacagcacccccttcaccttcggccccggcaccaaggtggacatcaga

SEQ ID NO: 31783 - RNA, 390 nt, synthetic construct
  misc_feature 1..390: note = derived and/or modified sequence opt4 from anti-HIV_M66.6_HeavyChain
  source 1..390: mol_type = other RNA
caggtgcagctggtgcagagcggcgccgaggtgaagaagcccggcgagagcctgaagatcagctgcaaggtgagcggctacaacttcgccagcgagtggatcggctgggtgagacagatgcccggcaagggcctggagtggatgggcatcatctaccccggcgacagcgacaccaagtacagccccagcttccagggccaggtgatcatcagcgccgacaagagcatcaacaccgcctacctgcagtggagcagcctgaaggccagcgacaccgccatctactactgcgccagacagaaccactacggcagcggcagctacttctacagaaccgcctactactacgccatggacgtgtggggccagggcaccaccgtgaccgtgagcagc

SEQ ID NO: 31784 - RNA, 327 nt, synthetic construct
  misc_feature 1..327: note = derived and/or modified sequence opt4 from anti-HIV_NIH45-46_LightChain
  source 1..327: mol_type = other RNA
gagatcgtgctgacccagagccccgccaccctgagcctgagccccggcgagaccgccatcatcagctgcagaaccagccagagcggcagcctggcctggtaccagcagagacccggccaggcccccagactggtgatctacagcggcagcaccagagccgccggcatccccgacagattcagcggcagcagatggggcgccgactacaacctgagcatcagcaacctggagagcggcgacttcggcgtgtactactgccagcagtacgagttcttcggccagggcaccaaggtgcaggtggacatcaagagaaccgtggccgccccc

SEQ ID NO: 31785 - RNA, 399 nt, synthetic construct
  misc_feature 1..399: note = derived and/or modified sequence opt4 from anti-HIV_NIH45-46_HeavyChain
  source 1..399: mol_type = other RNA
caggtgagactgagccagagcggcggccagatgaagaagcccggcgagagcatgagactgagctgcagagccagcggctacgagttcctgaactgccccatcaactggatcagactggcccccggcagaagacccgagtggatgggctggctgaagcccagaggcggcgccgtgaactacgccagaaagttccagggcagagtgaccatgaccagagacgtgtacagcgacaccgccttcctggagctgagaagcctgaccagcgacgacaccgccgtgtacttctgcaccagaggcaagtactgcaccgccagagactactacaactgggacttcgagcactggggcagaggcgcccccgtgaccgtgagcagcgccagcaccaagggccccagcgtg

SEQ ID NO: 31786 - RNA, 330 nt, synthetic construct
  misc_feature 1..330: note = derived and/or modified sequence opt4 from anti-HIV_PG16_LightChain
  source 1..330: mol_type = other RNA
cagagcgccctgacccagcccgccagcgtgagcggcagccccggccagaccatcaccatcagctgcaacggcaccagcagcgacgtgggcggcttcgacagcgtgagctggtaccagcagagccccggcaaggcccccaaggtgatggtgttcgacgtgagccacagacccagcggcatcagcaacagattcagcggcagcaagagcggcaacaccgccagcctgaccatcagcggcctgcacatcgaggacgagggcgactacttctgcagcagcctgaccgacagaagccacagaatcttcggcggcggcaccaaggtgaccgtgctg

SEQ ID NO: 31787 - RNA, 411 nt, synthetic construct
  misc_feature 1..411: note = derived and/or modified sequence opt4 from anti-HIV_PG16_HeavyChain
  source 1..411: mol_type = other RNA
caggagcagctggtggagagcggcggcggcgtggtgcagcccggcggcagcctgagactgagctgcctggccagcggcttcaccttccacaagtacggcatgcactgggtgagacaggcccccggcaagggcctggagtgggtggccctgatcagcgacgacggcatgagaaagtaccacagcgacagcatgtggggcagagtgaccatcagcagagacaacagcaagaacaccctgtacctgcagttcagcagcctgaaggtggaggacaccgccatgttcttctgcgccagagaggccggcggccccatctggcacgacgacgtgaagtactacgacttcaacgacggctactacaactaccactacatggacgtgtggggcaagggcaccaccgtgaccgtgagcagc

SEQ ID NO: 31788 - RNA, 315 nt, synthetic construct
  misc_feature 1..315: note = derived and/or modified sequence opt4 from anti-HIV_PGT122_LightChain
  source 1..315: mol_type = other RNA
accttcgtgagcgtggcccccggccagaccgccagaatcacctgcggcgaggagagcctgggcagcagaagcgtgatctggtaccagcagagacccggccaggcccccagcctgatcatctacaacaacaacgacagacccagcggcatccccgacagattcagcggcagccccggcagcaccttcggcaccaccgccaccctgaccatcaccagcgtggaggccggcgacgaggccgactactactgccacatctgggacagcagaagacccaccaactgggtgttcggcgagggcaccaccctgatcgtgctg

SEQ ID NO: 31789 - RNA, 396 nt, synthetic construct
  misc_feature 1..396: note = derived and/or modified sequence opt4 from anti-HIV_PGT122_HeavyChain
  source 1..396: mol_type = other RNA
caggtgcacctgcaggagagcggccccggcctggtgaagcccagcgagaccctgagcctgacctgcaacgtgagcggcaccctggtgagagacaactactggagctggatcagacagcccctgggcaagcagcccgagtggatcggctacgtgcacgacagcggcgacaccaactacaaccccagcctgaagagcagagtgcacctgagcctggacaagagcaagaacctggtgagcctgagactgaccggcgtgaccgccgccgacagcgccatctactactgcgccaccaccaagcacggcagaagaatctacggcgtggtggccttcaaggagtggttcacctacttctacatggacgtgtggggcaagggcaccagcgtgaccgtgagcagc

SEQ ID NO: 31790 - RNA, 315 nt, synthetic construct
  misc_feature 1..315: note = derived and/or modified sequence opt4 from anti-HIV_PGT123_LightChain
  source 1..315: mol_type = other RNA
agcagcatgagcgtgagccccggcgagaccgccaagatcagctgcggcaaggagagcatcggcagcagagccgtgcagtggtaccagcagaagcccggccagccccccagcctgatcatctacaacaaccaggacagacccgccggcgtgcccgagagattcagcgccagccccgacttcagacccggcaccaccgccaccctgaccatcaccaacgtggacgccgaggacgaggccgactactactgccacatctacgacgccagaggcggcaccaactgggtgttcgacagaggcaccaccctgaccgtgctg

SEQ ID NO: 31791 - RNA, 396 nt, synthetic construct
  misc_feature 1..396: note = derived and/or modified sequence opt4 from anti-HIV_PGT123_HeavyChain
  source 1..396: mol_type = other RNA
cagctgcacctgcaggagagcggccccggcctggtgaagccccccgagaccctgagcctgacctgcagcgtgagcggcgccagcatcaacgacgcctactggagctggatcagacagagccccggcaagagacccgagtgggtgggctacgtgcaccacagcggcgacaccaactacaaccccagcctgaagagaagagtgaccttcagcctggacaccgccaagaacgaggtgagcctgaagctggtggacctgaccgccgccgacagcgccacctacttctgcgccagagccctgcacggcaagagaatctacggcatcgtggccctgggcgagctgttcacctacttctacatggacgtgtggggcaagggcaccgccgtgaccgtgagcagc

SEQ ID NO: 31792 - RNA, 315 nt, synthetic construct
  misc_feature 1..315: note = derived and/or modified sequence opt4 from anti-HIV_PGT125_LightChain
  source 1..315: mol_type = other RNA
cagagcgccctgacccagccccccagcgccagcggcagccccggccagagcatcaccatcagctgcaacggcaccgccaccaacttcgtgagctggtaccagcagttccccgacaaggcccccaagctgatcatcttcggcgtggacaagagaccccccggcgtgcccgacagattcagcggcagcagaagcggcaccaccgccagcctgaccgtgagcagactgcagaccgacgacgaggccgtgtactactgcggcagcctggtgggcaactgggacgtgatcttcggcggcggcaccaccctgaccgtgctg

SEQ ID NO: 31793 - RNA, 411 nt, synthetic construct
  misc_feature 1..411: note = derived and/or modified sequence opt4 from anti-HIV_PGT125_HeavyChain
  source 1..411: mol_type = other RNA
cagagccagctgcaggagagcggccccagactggtggaggccagcgagaccctgagcctgacctgcaacgtgagcggcgagagcaccggcgcctgcacctacttctggggctgggtgagacaggcccccggcaagggcctggagtggatcggcagcctgagccactgccagagcttctggggcagcggctggaccttccacaaccccagcctgaagagcagactgaccatcagcctggacacccccaagaaccaggtgttcctgaagctgaccagcctgaccgccgccgacaccgccacctactactgcgccagattcgacggcgaggtgctggtgtacaaccactggcccaagcccgcctgggtggacctgtggggcagaggcatccccgtgaccgtgaccgtgagcagc

SEQ ID NO: 31794 - RNA, 315 nt, synthetic construct
  misc_feature 1..315: note = derived and/or modified sequence opt4 from anti-HIV_PGT126_LightChain
  source 1..315: mol_type = other RNA
cagagcgccctgacccagccccccagcgccagcggcagccccggccagagcatcagcatcagctgcaccggcaccagcaacagattcgtgagctggtaccagcagcaccccggcaaggcccccaagctggtgatctacggcgtgaacaagagacccagcggcgtgcccgacagattcagcggcagcaagagcggcaacaccgccagcctgaccgtgagcggcctgcagaccgacgacgaggccgtgtactactgcagcagcctggtgggcaactgggacgtgatcttcggcggcggcaccaagctgaccgtgctg

SEQ ID NO: 31795 - RNA, 411 nt, synthetic construct
  misc_feature 1..411: note = derived and/or modified sequence opt4 from anti-HIV_PGT126_HeavyChain
  source 1..411: mol_type = other RNA
cagccccagctgcaggagagcggccccggcctggtggaggccagcgagaccctgagcctgacctgcaccgtgagcggcgacagcaccgccgcctgcgactacttctggggctgggtgagacagccccccggcaagggcctggagtggatcggcggcctgagccactgcgccggctactacaacaccggctggacctaccacaaccccagcctgaagagcagactgaccatcagcctggacacccccaagaaccaggtgttcctgaagctgaacagcgtgaccgccgccgacaccgccatctactactgcgccagattcgacggcgaggtgctggtgtaccacgactggcccaagcccgcctgggtggacctgtggggcagaggcaccctggtgaccgtgaccgtgagcagc

SEQ ID NO: 31796 - RNA, 315 nt, synthetic construct
  misc_feature 1..315: note = derived and/or modified sequence opt4 from anti-HIV_PGT127_LightChain
  source 1..315: mol_type = other RNA
cagagcgccctgacccagccccccagcgccagcggcagccccggccagagcatcaccatcagctgcaccggcaccagcaacaacttcgtgagctggtaccagcagtaccccggcaaggcccccaagctggtgatctacgaggtgaacaagagacccagcggcgtgcccgacagattcagcggcagcaagagcggcagcaccgccagcctgaccgtgagcggcctgcaggccgacgacgagggcgtgtactactgcagcagcctggtgggcaactgggacgtgatcttcggcggcggcaccaagctgaccgtgctg

SEQ ID NO: 31797 - RNA, 405 nt, synthetic construct
  misc_feature 1..405: note = derived and/or modified sequence opt4 from anti-HIV_PGT127_HeavyChain
  source 1..405: mol_type = other RNA
cagccccagctgcaggagagcggccccggcctggtggaggccagcgagaccctgagcctgacctgcaccgtgagcggcgacagcaccggcagatgcaactacttctggggctgggtgagacagccccccggcaagggcctggagtggatcggcagcctgagccactgcagaagctactacaacaccgactggacctaccacaaccccagcctgaagagcagactgaccatcagcctggacacccccaagaaccaggtgttcctgagactgaccagcgtgaccgccgccgacaccgccacctactactgcgccagattcggcggcgaggtgctggtgtacagagactggcccaagcccgcctgggtggacctgtggggcagaggcaccctggtgaccgtgagcagc

SEQ ID NO: 31798 - RNA, 315 nt, synthetic construct
  misc_feature 1..315: note = derived and/or modified sequence opt4 from anti-HIV_PGT128_LightChain
  source 1..315: mol_type = other RNA
cagagcgccctgacccagccccccagcgccagcggcagccccggccagagcatcaccatcagctgcaccggcaccagcaacaacttcgtgagctggtaccagcagcacgccggcaaggcccccaagctggtgatctacgacgtgaacaagagacccagcggcgtgcccgacagattcagcggcagcaagagcggcaacaccgccagcctgaccgtgagcggcctgcagaccgacgacgaggccgtgtactactgcggcagcctggtgggcaactgggacgtgatcttcggcggcggcaccaagctgaccgtgctg

SEQ ID NO: 31799 - RNA, 405 nt, synthetic construct
  misc_feature 1..405: note = derived and/or modified sequence opt4 from anti-HIV_PGT128_HeavyChain
  source 1..405: mol_type = other RNA
cagccccagctgcaggagagcggccccaccctggtggaggccagcgagaccctgagcctgacctgcgccgtgagcggcgacagcaccgccgcctgcaacagcttctggggctgggtgagacagccccccggcaagggcctggagtgggtgggcagcctgagccactgcgccagctactggaacagaggctggacctaccacaaccccagcctgaagagcagactgaccctggccctggacacccccaagaacctggtgttcctgaagctgaacagcgtgaccgccgccgacaccgccacctactactgcgccagattcggcggcgaggtgctgagatacaccgactggcccaagcccgcctgggtggacctgtggggcagaggcaccctggtgaccgtgagcagc

SEQ ID NO: 31800 - RNA, 330 nt, synthetic construct
  misc_feature 1..330: note = derived and/or modified sequence opt4 from anti-HIV_PGT130_LightChain
  source 1..330: mol_type = other RNA
cagagcgccctgacccagccccccagcgccagcggcagcctgggccagagcgtgaccatcagctgcaacggcaccagcagcgacatcggcggctggaacttcgtgagctggtaccagcagttccccggcagagcccccagactgatcatcttcgaggtgaacaagagacccagcggcgtgcccggcagattcagcggcagcaagagcggcaacagcgccagcctgaccgtgagcggcctgcagagcgacgacgagggccagtacttctgcagcagcctgttcggcagatgggacgtggtgttcggcggcggcaccaagctgaccgtgctg

SEQ ID NO: 31801 - RNA, 387 nt, synthetic construct
  misc_feature 1..387: note = derived and/or modified sequence opt4 from anti-HIV_PGT130_HeavyChain
  source 1..387: mol_type = other RNA
caggtgcagctgcaggagagcggccccggcctggtgaagcccgccgagaccctgagcctgacctgcagcgtgagcggcgagagcatcaacaccggccactactactggggctgggtgagacaggtgcccggcaagggcctggagtggatcggccacatccactacaccaccgccgtgctgcacaaccccagcctgaagagcagactgaccatcaagatctacaccctgagaaaccagatcaccctgagactgagcaacgtgaccgccgccgacaccgccgtgtaccactgcgtgagaagcggcggcgacatcctgtactactacgagtggcagaagccccactggttcagcccctggggccccggcatccacgtgaccgtgagcagc

SEQ ID NO: 31802 - RNA, 330 nt, synthetic construct
  misc_feature 1..330: note = derived and/or modified sequence opt4 from anti-HIV_PGT131_LightChain
  source 1..330: mol_type = other RNA
cagagcgccctgacccagccccccagcgccagcggcagcctgggccagagcctgaccatcagctgcagcggcaccggcagcgacatcggcagctggaacttcgtgagctggtaccagcagttccccggcagagcccccaacctgatcatcttcgaggtgaacagaagaagaagcggcgtgcccgacagattcagcggcagcaagagcggcaacaccgccagcctgaccgtgagcggcctgagaagcgaggacgaggccgagtacttctgcagcagcctgagcggcagatgggacatcgtgttcggcggcggcaccaaggtgaccgtgctg

SEQ ID NO: 31803 - RNA, 387 nt, synthetic construct
  misc_feature 1..387: note = derived and/or modified sequence opt4 from anti-HIV_PGT131_HeavyChain
  source 1..387: mol_type = other RNA
caggtgcagctgcaggagagcggccccggcctggtgaagcccagcgagaccctgagcctgacctgcaccgtgagcggcgacagcatcaacaccggccaccactactggggctgggtgagacaggtgcccggcaagggccccgagtggatcgcccacatccactacaacaccgccgtgctgcacaaccccgccctgaagagcagagtgaccatcagcatcttcaccctgaagaacctgatcaccctgagcctgagcaacgtgaccgccgccgacaccgccgtgtacttctgcgtgagaagcggcggcgacatcctgtactacatcgagtggcagaagccccactggttctacccctggggccccggcatcctggtgaccgtgagcagc

SEQ ID NO: 31804 - RNA, 321 nt, synthetic construct
  misc_feature 1..321: note = derived and/or modified sequence opt4 from anti-HIV_PGT135_LightChain
  source 1..321: mol_type = other RNA
gagatcgtgatgacccagagccccgacaccctgagcgtgagccccggcgagaccgtgaccctgagctgcagagccagccagaacatcaacaagaacctggcctggtaccagtacaagcccggccagagccccagactggtgatcttcgagacctacagcaagatcgccgccttccccgccagattcgtggccagcggcagcggcaccgagttcaccctgaccatcaacaacatgcagagcgaggacgtggccgtgtactactgccagcagtacgaggagtggcccagaaccttcggccagggcaccaaggtggacatcaag

SEQ ID NO: 31805 - RNA, 399 nt, synthetic construct
  misc_feature 1..399: note = derived and/or modified sequence opt4 from anti-HIV_PGT135_HeavyChain
  source 1..399: mol_type = other RNA
cagctgcagatgcaggagagcggccccggcctggtgaagcccagcgagaccctgagcctgagctgcaccgtgagcggcgacagcatcagaggcggcgagtggggcgacaaggactaccactggggctgggtgagacacagcgccggcaagggcctggagtggatcggcagcatccactggagaggcaccacccactacaaggagagcctgagaagaagagtgagcatgagcatcgacaccagcagaaactggttcagcctgagactggccagcgtgaccgccgccgacaccgccgtgtacttctgcgccagacacagacaccacgacgtgttcatgctggtgcccatcgccggctggttcgacgtgtggggccccggcgtgcaggtgaccgtgagcagc

SEQ ID NO: 31806 - RNA, 321 nt, synthetic construct
  misc_feature 1..321: note = derived and/or modified sequence opt4 from anti-HIV_PGT136_LightChain
  source 1..321: mol_type = other RNA
gagatcgtgatgacccagagcccccccaccctgagcgtgagccccggcgagaccgccaccctgagctgcagagccagccagaacgtgaagaacaacctggcctggtaccagctgaagcccggccaggcccccagactgctgatcttcgacgccagcagcagagccggcggcatccccgacagattcagcggcagcggctacggcaccgacttcaccctgaccgtgaacagcgtgcagagcgaggacttcggcgactacttctgccagcagtacgaggagtggcccagaaccttcggccagggcaccaaggtggacatcaag

SEQ ID NO: 31807 - RNA, 402 nt, synthetic construct
  misc_feature 1..402: note = derived and/or modified sequence opt4 from anti-HIV_PGT136_HeavyChain
  source 1..402: mol_type = other RNA
cagctgcagctgcaggagagcggccccggcctggtgaagcccagcgagaccctgagcctgacctgcaccgtgagcggcggcagcatgagaggcaccgactggggcgagaacgacttccactacggctggatcagacagagcagcgccaagggcctggagtggatcggcagcatccactggagaggcagaaccacccactacaagaccagcttcagaagcagagccaccctgagcatcgacaccagcaacaacagattcagcctgaccttcagcttcgtgaccgccgccgacaccgccgtgtactactgcgccagacacaagtaccacgacatcttcagagtggtgcccgtggccggctggttcgacccctggggccagggcctgctggtgaccgtgagcagc

SEQ ID NO: 31808 - RNA, 321 nt, synthetic construct
  misc_feature 1..321: note = derived and/or modified sequence opt4 from anti-HIV_PGT137_LightChain
  source 1..321: mol_type = other RNA
gagatcatgatgacccagagccccgccatcctgagcgtgagccccggcgacagagccaccctgagctgcagagccagccagagcgtgaagaacaacctggcctggtaccagaagagacccggccaggcccccagactgctgatcttcgacaccagcagcagagccagcggcatccccgccagattcagcggcggcggcagcggcaccgagttcaccctgaccgtgaacagcatgcagagcgaggacttcgccacctactactgccagcagtacgaggagtggcccagaaccttcggccagggcaccaaggtggagatcaag

SEQ ID NO: 31809 - RNA, 399 nt, synthetic construct
  misc_feature 1..399: note = derived and/or modified sequence opt4 from anti-HIV_PGT137_HeavyChain
  source 1..399: mol_type = other RNA
gaggtgcacctggaggagagcggccccggcctggtgagacccagcgagaccctgagcctgacctgcaccgccagcggcggcagcatcagaggcggcgagtggggcgacagcgactaccactggggctgggtgagacacagccccgagaagggcctggagtggatcggcagcatccactggagaggcaccacccactacaacgcccccttcagaggcagaggcagactgagcatcgacctgagcagaaaccagttcagcctgagactgaccagcgtgaccgccgaggacaccgccgtgtactactgcgtgaagcacaagtaccacgacatcgtgatggtggtgcccatcgccggctggttcgacccctggggccagggcctgcaggtgaccgtgagcagc

SEQ ID NO: 31810 - RNA, 336 nt, synthetic construct
  misc_feature 1..336: note = derived and/or modified sequence opt4 from anti-HIV_PGT141_LightChain
  source 1..336: mol_type = other RNA
gacaccgtggtgacccagagccccctgagcctgcccgtgacccccggcgaggccgccagcatgagctgcagcagcacccagagcctgagacacagcaacggcgccaactacctggcctggtaccagcacaagcccggccagagccccagactgctgatcagactgggcagccagagagccagcggcgtgcccgacagattcagcggcagcggcagcggcacccacttcaccctgaagatcagcagagtggaggccgaggacgccgccatctactactgcatgcagggcctgaacagaccctggaccttcggcaagggcaccaagctggagatcaag

SEQ ID NO: 31811 - RNA, 423 nt, synthetic construct
  misc_feature 1..423: note = derived and/or modified sequence opt4 from anti-HIV_PGT141_HeavyChain
  source 1..423: mol_type = other RNA
caggtgcagctggtgcagagcggccccgaggtgaagaagcccggcagcagcgtgaaggtgagctgcaaggccagcggcaacaccttcagcaagtacgacgtgcactgggtgagacaggccaccggccagggcctggagtgggtgggctggatgagccacgagggcgacaagaccgagagcgcccagagattcaagggcagagtgaccttcaccagagacaccagcgccagcaccgcctacatggagctgagaggcctgaccagcgacgacaccgccatctactactgcaccagaggcagcaagcacagactgagagactacgtgctgtacgacgactacggcctgatcaactaccaggagtggaacgactacctggagttcctggacgtgtggggccacggcaccgccgtgaccgtgagcagc

SEQ ID NO: 31812 - RNA, 336 nt, synthetic construct; identical to SEQ ID NO: 31810
  misc_feature 1..336: note = derived and/or modified sequence opt4 from anti-HIV_PGT142_LightChain
  source 1..336: mol_type = other RNA

SEQ ID NO: 31813 - RNA, 423 nt, synthetic construct
  misc_feature 1..423: note = derived and/or modified sequence opt4 from anti-HIV_PGT142_HeavyChain
  source 1..423: mol_type = other RNA
caggtgcagctggtgcagagcggccccgaggtgaagaagcccggcagcagcgtgaaggtgagctgcaaggccagcggcaacaccttcagcaagtacgacgtgcactgggtgagacaggccaccggccagggcctggagtgggtgggctggatcagccacgagagagacaagaccgagagcgcccagagattcaagggcagagtgaccttcaccagagacaccagcgccaccaccgcctacatggagctgagaggcctgaccagcgacgacaccgccatctactactgcaccagaggcagcaagcacagactgagagactacgtgctgtacgacgactacggcctgatcaactaccaggagtggaacgactacctggagttcctggacgtgtggggccacggcaccgccgtgaccgtgagcagc

SEQ ID NO: 31814 - RNA, 336 nt, synthetic construct
  misc_feature 1..336: note = derived and/or modified sequence opt4 from anti-HIV_PGT143_LightChain
  source 1..336: mol_type = other RNA
gacaccgtggtgacccagagccccctgagcctgcccgtgacccccggcgaggccgccagcatgagctgcaccagcacccagagcctgagacacagcaacggcgccaactacctggcctggtaccagcacaagcccggccagagccccagactgctgatcagactgggcagccagagagccagcggcgtgcccgacagattcagcggcagcggcagcggcacccacttcaccctgaagatcagcagagtggagcccgaggacgccgccatctactactgcatgcagggcctgaacagaccctggaccttcggcaagggcaccaagctggagatcaag

SEQ ID NO: 31815 - RNA, 423 nt, synthetic construct
  misc_feature 1..423: note = derived and/or modified sequence opt4 from anti-HIV_PGT143_HeavyChain
  source 1..423: mol_type = other RNA
caggtgcagctggagcagagcggcgccgaggtgaagaagcccggcagcagcgtgaaggtgagctgcaaggccagcggcaacaccttcagcaagtacgacgtgcactgggtgagacaggccaccggccagggcctggagtgggtgggctggatgagccacgagggcgacaagaccgagagcgcccagagattcaagggcagagtgaccttcaccagagacaccagcgccagcaccgcctacatggagctgagaggcctgaccagcgacgacaccgccatctactactgcaccagaggcagcaagcacagactgagagactacgtgctgtacgacgactacggcctgatcaactaccaggagtggaacgactacctggagttcctggacgtgtggggccacggcaccgccgtgaccgtgagcagc

SEQ ID NO: 31816 - RNA, 336 nt, synthetic construct
  misc_feature 1..336: note = derived and/or modified sequence opt4 from anti-HIV_PGT144_LightChain
  source 1..336: mol_type = other RNA
gacaccgtggtgacccagagccccctgagcctgagcgtgacccccggcgaggccgccagcatgagctgcaccagcacccagagcctgagacacagcaacggcgccaactacctggcctggtaccagcacaagcccggccagagccccagactgctgatcagactgggcagccagagagccagcggcgtgcccgacagattcagcggcagcggcagcggcacccacttcaccctgaagatcagcagagtggaggccgacgacgccgccatctactactgcatgcagggcctgaacagaccctggaccttcggcaagggcaccaagctggagatcaag

SEQ ID NO: 31817 - RNA, 423 nt, synthetic construct
  misc_feature 1..423: note = derived and/or modified sequence opt4 from anti-HIV_PGT144_HeavyChain
  source 1..423: mol_type = other RNA
caggtgcagctggtgcagagcggcgccgaggtgaagaagcccggcagcagcgtgaaggtgagctgcaaggccagcggcaacaccttcagaaagtacgacgtgcactgggtgagacaggccaccggccagggcctggagtgggtgggctggatgagccacgagggcgacaagaccgagagcgcccagagattcaagggcagagtgagcttcaccagagacaacagcgccagcaccgcctacatcgagctgagaggcctgaccagcgacgacaccgccatctactactgcaccggcggcagcaagcacagactgagagactacgtgctgtacgacgactacggcctgatcaaccagcaggagtggaacgactacctggagttcctggacgtgtggggccacggcaccgccgtgaccgtgagcagc

SEQ ID NO: 31818 - RNA, 336 nt, synthetic construct
  misc_feature 1..336: note = derived and/or modified sequence opt4 from anti-HIV_PGT145_LightChain
  source 1..336: mol_type = other RNA
gaggtggtgatcacccagagccccctgttcctgcccgtgacccccggcgaggccgccagcctgagctgcaagtgcagccacagcctgcagcacagcaccggcgccaactacctggcctggtacctgcagagacccggccagacccccagactgctgatccacctggccacccacagagccagcggcgtgcccgacagattcagcggcagcggcagcggcaccgacttcaccctgaagatcagcagagtggagagcgacgacgtgggcacctactactgcatgcagggcctgcacagcccctggaccttcggccagggcaccaaggtggagatcaag

SEQ ID NO: 31819 - RNA, 420 nt, synthetic construct
  misc_feature 1..420: note = derived and/or modified sequence opt4 from anti-HIV_PGT145_HeavyChain
  source 1..420: mol_type = other RNA
caggtgcagctggtgcagagcggcgccgaggtgaagaagcccggcagcagcgtgaaggtgagctgcaaggccagcggcaacagcttcagcaaccacgacgtgcactgggtgagacaggccaccggccagggcctggagtggatgggctggatgagccacgagggcgacaagaccggcctggcccagaagttccagggcagagtgaccatcaccagagacagcggcgccagcaccgtgtacatggagctgagaggcctgaccgccgacgacaccgccatctactactgcctgaccggcagcaagcacagactgagagactacttcctgtacaacgagtacggccccaactacgaggagtggggcgactacctggccaccctggacgtgtggggccacggcaccgccgtgaccgtgagcagc

SEQ ID NO: 31820 - RNA, 657 nt, synthetic construct
  misc_feature 1..657: note = derived and/or modified sequence opt4 from anti-HIV_PGT151_LightChain
  source 1..657: mol_type = other RNA
gacatcgtgatgacccagacccccctgagcctgagcgtgacccccggccagcccgccagcatcagctgcaagagcagcgagagcctgagacagagcaacggcaagaccagcctgtactggtacagacagaagcccggccagagcccccagctgctggtgttcgaggtgagcaacagattcagcggcgtgagcgacagattcgtgggcagcggcagcggcaccgacttcaccctgagaatcagcagagtggaggccgaggacgtgggcttctactactgcatgcagagcaaggacttccccctgaccttcggcggcggcaccaaggtggacctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31821 - RNA, 720 nt, synthetic construct
  misc_feature 1..720: note = derived and/or modified sequence opt4 from anti-HIV_PGT151_HeavyChain
  source 1..720: mol_type = other RNA
agagtgcagctggtggagagcggcggcggcgtggtgcagcccggcaagagcgtgagactgagctgcgtggtgagcgacttccccttcagcaagtaccccatgtactgggtgagacaggcccccggcaagggcctggagtgggtggccgccatcagcggcgacgcctggcacgtggtgtacagcaacagcgtgcagggcagattcctggtgagcagagacaacgtgaagaacaccctgtacctggagatgaacagcctgaagatcgaggacaccgccgtgtacagatgcgccagaatgttccaggagagcggcccccccagactggacagatggagcggcagaaactactactactacagcggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaag

SEQ ID NO: 31822 - RNA, 657 nt, synthetic construct
  misc_feature 1..657: note = derived and/or modified sequence opt4 from anti-HIV_PGT152_LightChain
  source 1..657: mol_type = other RNA
gacatcgtgatgacccagacccccctgagcctgagcgtggaccccggccagcccgccagcatcagctgcaagagcagccagagcctgagacagagcaacggcaagaccagcctgtactggtaccagcagaagcccggccagagcccccagctgctgatcttcgaggtgagcaacagattcagcggcgtgagcgacagattcgtgggcagcggcagcggcaccgacttcaccctgagaatcagcagagtggaggccgaggacgtgggcttctactactgcatgcagagcaaggacttccccctgaccttcggcggcggcaccaaggtggacctgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31823 - RNA, 720 nt, synthetic construct
  misc_feature 1..720: note = derived and/or modified sequence opt4 from anti-HIV_PGT152_HeavyChain
  source 1..720: mol_type = other RNA
agagtgcagctggtggagagcggcggcggcgtggtgcagcccggcaagagcgtgagactgagctgcgtggtgagcgacttccccttcagcaagtaccccatgtactgggtgagacaggcccccggcaagggcctggagtgggtggccgccatcagcgccgacgcctggcacgtggtgtacagcggcagcgtgcagggcagattcctggtgagcagagacaacagcaagaacatcctgtacctggagatgaacaccctgaagatcgaggacaccgccgtgtacagatgcgccagaatgttccaggagagcggcccccccagattcgacagctggagcggcagaaactactactactacagcggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaag

SEQ ID NO: 31824 - RNA, 309 nt, synthetic construct
  misc_feature 1..309: note = derived and/or modified sequence opt4 from anti-HIV_VRC-CH30_LightChain
  source 1..309: mol_type = other RNA
gacatccagatgacccagagccccagcagcctgagcgccagcctgggcgacagagtgaccatcacctgccaggccagcagaggcatcggcaaggacctgaactggtaccagcagaagcccggcaaggcccccaagctgctggtgagcgacgccagcatcctggagggcggcgtgcccagcagattcagcggcagcggcttccaccagaacttcagcctgaccatcagcagcctgcagcccgaggacgtggccacctacttctgccagcagtacgagaccttcggccagggcaccaaggtggacatcaag

SEQ ID NO: 31825 - RNA, 393 nt, synthetic construct
  misc_feature 1..393: note = derived and/or modified sequence opt4 from anti-HIV_VRC-CH30_HeavyChain
  source 1..393: mol_type = other RNA
caggtgcagctggtgcagagcggcgccgccgtgagaaagcccggcgccagcgtgaccgtgagctgcaagttcgccgaggacgacgactacagcccccactgggtgaaccccgcccccgagcactacatccacttcctgagacaggcccccggccagcagctggagtggctggcctggatgaaccccaccaacggcgccgtgaactacgcctggcagctgcacggcagactgaccgccaccagagacggcagcatgaccaccgccttcctggaggtgagaagcctgagaagcgacgacaccgccgtgtactactgcgccagagcccagaagagaggcagaagcgagtgggcctacgcccactggggccagggcacccccgtggccgtgagcagc

SEQ ID NO: 31826 - RNA, 309 nt, synthetic construct
  misc_feature 1..309: note = derived and/or modified sequence opt4 from anti-HIV_VRC-CH31_LightChain
  source 1..309: mol_type = other RNA
gacatccagatgacccagagccccagcagcctgagcgccagcctgggcgacagagtgaccatcacctgccaggccagcagaggcatcggcaaggacctgaactggtaccagcagaaggccggcaaggcccccaagctgctggtgagcgacgccagcaccctggagggcggcgtgcccagcagattcagcggcagcggcttccaccagaacttcagcctgaccatcagcagcctgcaggccgaggacgtggccacctacttctgccagcagtacgagaccttcggccagggcaccaaggtggacatcaag

SEQ ID NO: 31827 - RNA, 393 nt, synthetic construct
  misc_feature 1..393: note = derived and/or modified sequence opt4 from anti-HIV_VRC-CH31_HeavyChain
  source 1..393: mol_type = other RNA
caggtgcagctggtgcagagcggcgccgccgtgagaaagcccggcgccagcgtgaccgtgagctgcaagttcgccgaggacgacgactacagcccctactgggtgaaccccgcccccgagcacttcatccacttcctgagacaggcccccggccagcagctggagtggctggcctggatgaaccccaccaacggcgccgtgaactacgcctggtacctgaacggcagagtgaccgccaccagagacagaagcatgaccaccgccttcctggaggtgaagagcctgagaagcgacgacaccgccgtgtactactgcgccagagcccagaagagaggcagaagcgagtgggcctacgcccactggggccagggcacccccgtggtggtgagcagc

SEQ ID NO: 31828 - RNA, 309 nt, synthetic construct
  misc_feature 1..309: note = derived and/or modified sequence opt4 from anti-HIV_VRC-CH32_LightChain
  source 1..309: mol_type = other RNA
gacatccagatgacccagagccccagcagcctgagcgccagcctgggcgacagagtgaccatcacctgccaggccagcagaggcatcggcaaggacctgaactggtaccagcagaagcccggcagagcccccaagctgctggtgagcgacgccagcatcctggagggcggcgtgcccaccagattcagcggcagcggcttccaccagaacttcagcctgaccatcagcagcctgcaggccgaggacgtggccacctacttctgccagcagtacgagaccttcggccagggcaccaaggtggacatcaag

SEQ ID NO: 31829 - RNA, 393 nt, synthetic construct
  misc_feature 1..393: note = derived and/or modified sequence opt4 from anti-HIV_VRC-CH32_HeavyChain
  source 1..393: mol_type = other RNA
caggtgcagctggtgcagagcggcgccgccgtgagaaagcccggcgccagcgtgaccgtgagctgcaagttcgccgaggacgacgacttcagcccccactgggtgaaccccgcccccgagcactacatccacttcctgagacaggcccccggccagcagctggagtggctggcctggatgaagcccaccaacggcgccgtgaactacgcctggcagctgcagggcagagtgaccgtgaccagagacagaagccagaccaccgccttcctggaggtgaagaacctgagaagcgacgacaccgccgtgtactactgcgccagagcccagaagagaggcagaagcgagtgggcctacgcccactggggccagggcacccccgtggtgatcagcgcc

SEQ ID NO: 31830 - RNA, 309 nt, synthetic construct
  misc_feature 1..309: note = derived and/or modified sequence opt4 from anti-HIV_VRC-CH33_LightChain
  source 1..309: mol_type = other RNA
gacatccagatgacccagagccccagcagcctgagcgccagcctgggcgacagagtgaccatcacctgccaggccagcagaggcatcggcaaggacctgaactggtaccagcagaagagaggcagagcccccagactgctggtgagcgacgccagcgtgctggagggcggcgtgcccagcagattcagcggcagcggcttccaccagaacttcagcctgaccatcagcaccctgcagcccgaggacgtggccacctacttctgccagcagtacgagaccttcggccagggcaccaaggtggacatcaag

SEQ ID NO: 31831 - RNA, 393 nt, synthetic construct
  misc_feature 1..393: note = derived and/or modified sequence opt4 from anti-HIV_VRC-CH33_HeavyChain
  source 1..393: mol_type = other RNA
caggtgcagctggtgcagagcggcgccgccgtgagaaagcccggcgccagcatcagcgtgagctgcaagttcgccgacgccgacgactacagcccccactggatgaaccccgcccccgagcactacatccacttcctgagacaggcccccggccagcagctggagtggctggcctggatgaaccccaccaacggcgccgtgaactacgcctggtacctgaacggcagagtgaccgccaccagagacagaagcatgaccaccgccttcctggaggtgagaagcctgagaagcgacgacaccgccgtgtactactgcgccagagcccagaagagagccagaagcgagtgggcctacgcccactggggccagggcacccccgtggtggtgagcagc

SEQ ID NO: 31832 - RNA, 309 nt, synthetic construct
  misc_feature 1..309: note = derived and/or modified sequence opt4 from anti-HIV_VRC-CH34_LightChain
  source 1..309: mol_type = other RNA
gacatccagatgacccagagccccagcagcctgagcgccagcctgggcgacagagtgaccatcacctgccaggccagcagaggcatcggcaaggacctgaactggtaccagcagaaggccggcaaggcccccaagctgctggtgagcgacgccagcatcctggagggcggcgtgcccagcagattcagcggcagcggcttccaccagaacttcagcctgaccatcagcagcctgcagcccgaggacgtggccacctacttctgccagcagtacgagaccttcggccagggcaccaaggtggacatcaag

SEQ ID NO: 31833 - RNA, 393 nt, synthetic construct
  misc_feature 1..393: note = derived and/or modified sequence opt4 from anti-HIV_VRC-CH34_HeavyChain
  source 1..393: mol_type = other RNA
caggtgcagctggtgcagagcggcgccgccgtgagaaagcccggcgccagcgtgaccgtgagctgcaagttcgccgaggacgacgactggagcccccactgggtgaaccccgcccccgagcactacatccacttcctgagacaggcccccggccagcagctggagtggctggcctggatgaaccccaccaacggcgccgtgaactacgcctggcagctgaacggcagactgaccgccaccagagacaccagcatgaccaccgccttcctggaggtgaagagcctgagaagcgacgacaccgccgtgtactactgcgccagagcccagaagagaggcagaagcgagtgggcctacgcccactggggccagggcacccccgtggtggtgagcagc

SEQ ID NO: 31834 - RNA, 306 nt, synthetic construct
  misc_feature 1..306: note = derived and/or modified sequence opt4 from anti-HIV_VRC-PG04_LightChain
  source 1..306: mol_type = other RNA
gagatcgtgctgacccagagccccggcaccctgagcctgagccccggcgagaccgccagcctgagctgcaccgccgccagctacggccacatgacctggtaccagaagaagcccggccagccccccaagctgctgatcttcgccaccagcaagagagccagcggcatccccgacagattcagcggcagccagttcggcaagcagtacaccctgaccatcaccagaatggagcccgaggacttcgccagatactactgccagcagctggagttcttcggccagggcaccagactggagatcagaaga

SEQ ID NO: 31835 - RNA, 375 nt, synthetic construct
  misc_feature 1..375: note = derived and/or modified sequence opt4 from anti-HIV_VRC-PG04_HeavyChain
  source 1..375: mol_type = other RNA
caggtgcagctggtgcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccgacttcagacagagagtgagcctgaccagagacagagacctgttcaccgcccacatggacatcagaggcctgacccagggcgacaccgccacctacttctgcgccagacagaagttctacaccggcggccagggctggtacttcgacctgtggggcagaggcaccctgatcgtggtgagcagc

SEQ ID NO: 31836 - RNA, 303 nt, synthetic construct
  misc_feature 1..303: note = derived and/or modified sequence opt4 from anti-HIV_VRC-PG04b_LightChain
  source 1..303: mol_type = other RNA
gagatcgtgctgacccagagccccggcaccctgagcctgagccccggcgagaccgccagcctgagctgcaccgccgccagctacggccacatgacctggtaccagaagaagcccggccagccccccaagctgctgatcttcgccaccagcaagagagccagcggcatccccgacagattcagcggcagccagttcggcaagcagtacaccctgaccatcaccagaatggagcccgaggacttcgccggctactactgccagcaggtggagttcttcggccagggcaccagactggagatcaga

SEQ ID NO: 31837 - RNA, 375 nt, synthetic construct
  misc_feature 1..375: note = derived and/or modified sequence opt4 from anti-HIV_VRC-PG04b_HeavyChain
  source 1..375: mol_type = other RNA
caggtgcagctggtgcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 31838 - RNA, 612 nt, synthetic construct
  misc_feature 1..612: note = derived and/or modified sequence opt4 from anti-HIV_VRC-PG20_LightChain
  source 1..612: mol_type = other RNA
cagagcgccctgacccagccccccagcgtgagcggcagccccggccagagcatcaccctgagctgcaccggcgccagcaccagcgtggcctggtaccagcagtacgccgacaaggcccccagactgatcgtgttcgacggcaacaagagacccagcgacatcagcagcagattcagcggcagccagagcggcggcaccgccagcctgaccatcagcggcctgcagagcgaggacgaggcctactaccactgcaacgccttcgagttcttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgc

SEQ ID NO: 31839 - RNA, 681 nt, synthetic construct
  misc_feature 1..681: note = derived and/or modified sequence opt4 from anti-HIV_VRC-PG20_HeavyChain
  source 1..681: mol_type = other RNA
gaggtgcacctgatgcagagcggcaccgagatgaagaagcccggcgccagcgtgagagtgacctgccagaccagcggctacaccttcagcgactacttcatccactggctgagacaggtgcccggcagaggcttcgagtggatgggctggatgaacccccagtggggccaggtgaactacgccagaaccttccagggcagagtgaccatgaccagagacgtgtacagagaggtggcctacctggacctgagaagcctgaccttcgccgacaccgccgtgtacttctgcgccagaagaatgagaagccaggacagagagtgggacttccagcactggggccagggcaccagaatcatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaag

SEQ ID NO: 31840 - RNA, 1059 nt, synthetic construct
  misc_feature 1..1059: note = derived and/or modified sequence opt4 from anti-HIV_VRC-PG20_G-Chain
  source 1..1059: mol_type = other RNA
gtgtggaaggacgccgacaccaccctgttctgcgccagcgacgccaaggcccacgagaccgaggtgcacaacgtgtgggccacccacgcctgcgtgcccaccgaccccaacccccaggagatccacctggagaacgtgaccgagaacttcaacatgtggaagaacaacatggtggagcagatgcaggaggacgtgatcagcctgtgggaccagagcctgcagccctgcgtgaagctgaccggcggcagcgtgatcaagcaggcctgccccaagatcagcttcgaccccatccccatccactactgcacccccgccggctacgtgatcctgaagtgcaacgacaagaacttcaacggcaccggcccctgcaagaacgtgagcagcgtgcagtgcacccacggcatcaagcccgtggtgagcacccagctgctgctgaacggcagcctggccgaggaggagatcatcatcagaagcgagaacctgaccaacaacgccaagaccatcatcgtgcacctgaacaagagcgtggagatcaactgcaccagacccagcaacggcggcagcggcagcggcggcgacatcagaaaggcctactgcgagatcaacggcaccaagtggaacaaggtgctgaagcaggtgaccgagaagctgaaggagcacttcaacaacaagaccatcatcttccagccccccagcggcggcgacctggagatcaccatgcaccacttcaactgcagaggcgagttcttctactgcaacaccacccagctgttcaacaacacctgcatcggcaacgagaccatgaagggctgcaacggcaccatcaccctgccctgcaagatcaagcagatcatcaacatgtggcagggcaccggccaggccatgtacgccccccccatcgacggcaagatcaactgcgtgagcaacatcaccggcatcctgctgaccagagacggcggcgccaacaacaccagcaacgagaccttcagacccggcggcggcaacatcaaggacaactggagaagcgagctgtacaagtacaaggtggtgcagatcgag

SEQ ID NO: 31841 - RNA, 312 nt, synthetic construct
  misc_feature 1..312: note = derived and/or modified sequence opt4 from anti-HIV_VRC02_LightChain
  source 1..312: mol_type = other RNA
gagatcgtgctgacccagagccccggcaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggccccgactacaacctgaccatcagaaacctggagagcggcgacttcggcctgtactactgccagcagtacgagttcttcggccagggcaccaaggtgcaggtggacatcaagaga

SEQ ID NO: 31842 - RNA, 363 nt, synthetic construct
  misc_feature 1..363: note = derived and/or modified sequence opt4 from anti-HIV_VRC02_HeavyChain
  source 1..363: mol_type = other RNA
caggtgcagctggtgcagagcggcggccagatgaagaagcccggcgagagcatgagaatcagctgccaggccagcggctacgagttcatcgactgcaccctgaactgggtgagactggcccccggcagaagacccgagtggatgggctggctgaagcccagaggcggcgccgtgaactacgccagacccctgcagggcagagtgaccatgaccagagacgtgtacagcgacaccgccttcctggagctgagaagcctgaccgccgacgacaccgccgtgtactactgcaccagaggcaagaactgcgactacaactgggacttcgagcactggggcagaggcacccccgtgaccgtgagcagc

SEQ ID NO: 31843 - RNA, 309 nt, synthetic construct
  misc_feature 1..309: note = derived and/or modified sequence opt4 from anti-HIV_VRC03_LightChain
  source 1..309: mol_type = other RNA
gagatcgtgctgacccagagccccggcatcctgagcctgagccccggcgagaccgccaccctgttctgcaaggccagccagggcggcaacgccatgacctggtaccagaagagaagaggccaggtgcccagactgctgatctacgacaccagcagaagagccagcggcgtgcccgacagattcgtgggcagcggcagcggcaccgacttcttcctgaccatcaacaagctggacagagaggacttcgccgtgtactactgccagcagttcgagttcttcggcctgggcagcgagctggaggtgcacaga

SEQ ID NO: 31844 - RNA, 390 nt, synthetic construct
  misc_feature 1..390: note = derived and/or modified sequence opt4 from anti-HIV_VRC03_HeavyChain
  source 1..390: mol_type = other RNA
caggtgcagctggtgcagagcggcgccgtgatcaagacccccggcagcagcgtgaagatcagctgcagagccagcggctacaacttcagagactacagcatccactgggtgagactgatccccgacaagggcttcgagtggatcggctggatcaagcccctgtggggcgccgtgagctacgccagacagctgcagggcagagtgagcatgaccagacagctgagccaggaccccgacgaccccgactggggcgtggcctacatggagttcagcggcctgacccccgccgacaccgccgagtacttctgcgtgagaagaggcagctgcgactactgcggcgacttcccctggcagtactggggccagggcaccgtggtggtggtgagcagc

SEQ ID NO: 31845 - RNA, 630 nt, synthetic construct
  misc_feature 1..630: note = derived and/or modified sequence opt4 from anti-HIV_VRC23_LightChain
  source 1..630: mol_type = other RNA
gagatcgtgatgacccagagccccgtgaccgtgagcgtgagcagaggcggcaccgccaccctgagctgcagagccagccagggcgtgggcagcgacgtggcctggtaccagcacaagcccggccagacccccagactgctgatctacggcgccagcaccagagccagcggcgtgcccgagagattcagcggcagcggcttccacgtggacttcaccctgagcatcagcggcctgcagcccgaggacgtggccatctactactgccagcagtacgagaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31846 - RNA, 672 nt, synthetic construct
  misc_feature 1..672: note = derived and/or modified sequence opt4 from anti-HIV_VRC23_HeavyChain
  source 1..672: mol_type = other RNA
gaggtgcagttcgtgcagagcggcgccgaggtgaagaagcccggcgccagcgtgagagtgagctgcgaggccagcggctacagcttcaccgactacgtgctgcagtggatcagacaggcccccggccagagacccgagtggatgggctggatcaagcccgagagaggcgccgtgagctacgccccccagttccagggcagactgaccctgaccagagacctgtacaccgagaccgcctacatgcacttcaagaacctgagaagcgacgacaccgccatctactactgcgccagaggcgtgagaagagacgccagctggtggctgcagttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31847 - RNA, 1077 nt, synthetic construct
  misc_feature 1..1077: note = derived and/or modified sequence opt4 from anti-HIV_VRC23_G-Chain
  source 1..1077: mol_type = other RNA
gtgtggagagacgccgacaccaccctgttctgcgccagcgacgccaaggcctacgagaccgagaagcacaacgtgtgggccacccacgcctgcgtgcccaccgaccccaacccccaggagatccacctggacaacgtgaccgagaagttcaacatgtggaagaacaacatggtggagcagatgcacaccgacatcatcagcctgtgggaccagagcctgaagccctgcgtgaagctgaccggcggcagcgccatcacccaggcctgccccaaggtgagcttcgagcccatccccatccactactgcacccccgccggcttcgccatcctgaagtgcaaggacgagggcttcaacggcaccggcctgtgcaagaacgtgagcaccgtgcagtgcacccacggcatcaagcccgtggtgagcacccagctgctgctgaacggcagcctggccgagaagaacatcaccatcagaagcgagaacatcaccaacaacgccaagatcatcatcgtgcagctggtgcagcccgtgaccatcaagtgcatcagacccaacaacggcggcagcggcagcggcggcgacatcagacaggcccactgcaacgtgaccagaagcagatggaacaagaccctgcaggaggtggccgagaagctgagaacctacttcggcaacaagaccatcatcttcgccaacagcagcggcggcgacctggagatcaccacccacagcttcaactgcggcggcgagttcttctactgcaacaccagcggcctgttcaacagcacctggtacgtgaacagcacctggaacgacaccgacagcacccaggagagcaacgacaccatcaccctgccctgcagaatcaagcagatcatcaacatgtggcagagagccggccaggccatgtacgccccccccatccccggcgtgatcaagtgcgagagcaacatcaccggcctgctgctgaccagagacggcggcaaggacaacaacgtgaacgagaccttcagacccggcggcggcgacatgagagacaactggagaagcgagctgtacaagtacaaggtggtggagatcgag

SEQ ID NO: 31848 - RNA, 648 nt, synthetic construct
  misc_feature 1..648: note = derived and/or modified sequence opt4 from anti-HIV_5CCK_LightChain
  source 1..648: mol_type = other RNA
cagagcgccctgacccagcccgccagcgtgagcgccagccccggccagagcatcaccatcagctgcagcggcaccagaagcgacgtgggcggctacgacttcgtgagctggtaccagcagcaccccggcaaggtgcccaagctgatcatctacgaggtgaccaagagacccagcggcatcccccagagattcagcggcagcaagagcggcaacaccgccagcctgaccatcagcggcctgcaggccgacgacgaggccgactactactgctgcagctacgccaactacgacaagctgatcctgggcggcggcaccaagctgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31849 - RNA, 696 nt, synthetic construct
  misc_feature 1..696: note = derived and/or modified sequence opt4 from anti-HIV_5CCK_HeavyChain
  source 1..696: mol_type = other RNA
caggtgcagctggtgcagagcggcgccgagatgaaggaccccggcgccagcgtgaaggtgagctgcagagccagcggctacaagttcaccgactactacatgcactgggtgagacaggcccccggccagggcctggagtgggtgggctgggtgaacaccaacggcggcttcaccaagtacggcgccaagttccagggcagagtgaccgtgaccagagacaccagcaccaacaccgtgttcctggagctgagcagactgaccttcggcgacaccgccatgtacttctgcgccagacccatgagacccgtgagccacggcatcgactacagcggcctgttcgtgttccagttctggggcagaggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgac

SEQ ID NO: 31850 - RNA, 648 nt, synthetic construct; identical to SEQ ID NO: 31726
  misc_feature 1..648: note = derived and/or modified sequence opt4 from anti-HIV_5AWN_LightChain
  source 1..648: mol_type = other RNA

SEQ ID NO: 31851 - RNA, 696 nt, synthetic construct
  misc_feature 1..696: note = derived and/or modified sequence opt4 from anti-HIV_5AWN_HeavyChain
  source 1..696: mol_type = other RNA
caggtgcagctgatgcagagcggcgcccagctgagagaccccggcgacagcctgaagatcagctgcaaggccagcggctacaacttcatcgactaccacatccactgggtgagactggcccccggcagaggcctggagtggatgggctggatcgaccccgtgggcggcatcaccaagtacgccggccagttccagggcagactgagcctgaccagagacaccagcaccaacaccctgttcctggagctgagcagactgaccgccggcgacaccgccgtgtacttctgcgccagaagcatgagacccgtggaccacggcatcgactacagcggcctgttcgtgttccacttctggggcagaggcagcgacgtgctggtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgac

SEQ ID NO: 31852 - RNA, 645 nt, synthetic construct
  misc_feature 1..645: note = derived and/or modified sequence opt4 from anti-HIV_3QEG_LightChain
  source 1..645: mol_type = other RNA
gagatcgtgatgatgcagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccgagaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31853 - RNA, 717 nt, synthetic construct
  misc_feature 1..717: note = derived and/or modified sequence opt4 from anti-HIV_3QEG_HeavyChain
  source 1..717: mol_type = other RNA
caggtgcagctggtgcagagcggcgccgaggtgaagaagcccggcagcagcgtgaaggtgagctgcagagccagcagaggcaccttcagcagctacggcatcacctgggtgagacaggcccccggccagggcctggagtggatgggcggcatcatccccatcttcgacgtgaccaactacgcccagaacttccagggcagagtggccatcaccaccgacgccgagatgagcaccgcctacatggagctgagaagcctgaagagcgaggacagcgccgtgtactactgcgccagcgacagcagagacttcagctactacgagcccggcaccagctacagccactactacaacatcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccac

SEQ ID NO: 31854 - RNA, 690 nt, synthetic construct
  misc_feature 1..690: note = derived and/or modified sequence opt4 from anti-HIV_1N0X_K-Chain
  source 1..690: mol_type = other RNA
caggtgcagctggtgcagagcggcgccgaggtgaagaagcccggcgccagcgtgaaggtgagctgccaggccagcggctacagattcagcaacttcgtgatccactgggtgagacaggcccccggccagagattcgagtggatgggctggatcaacccctacaacggcaacaaggagttcagcgccaagttccaggacagagtgaccttcaccgccgacaccagcgccaacaccgcctacatggagctgagaagcctgagaagcgccgacaccgccgtgtactactgcgccagagtgggcccctacagctgggacgacagcccccaggacaactactacatggacgtgtggggcaagggcaccaccgtgatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31855 - RNA, 645 nt, synthetic construct
  misc_feature 1..645: note = derived and/or modified sequence opt4 from anti-HIV_1N0X_M-Chain
  source 1..645: mol_type = other RNA
gagatcgtgctgacccagagccccggcaccctgagcctgagccccggcgagagagccaccttcagctgcagaagcagccacagcatcagaagcagaagagtggcctggtaccagcacaagcccggccaggcccccagactggtgatccacggcgtgagcaacagagccagcggcatcagcgacagattcagcggcagcggcagcggcaccgacttcaccctgaccatcaccagagtggagcccgaggacttcgccctgtactactgccaggtgtacggcgccagcagctacaccttcggccagggcaccaagctggagagaaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagaagccccgtgaccaagagcttcaacagaggcgagtgc

SEQ ID NO: 31856 - RNA, 654 nt, synthetic construct
  misc_feature 1..654: note = derived and/or modified sequence opt4 from anti-HIV_3QEH_HeavyChain
  source 1..654: mol_type = other RNA
gacatcgtgatgacccagagccccctgagcctgcccgtgacccccggcgaggccgccagcatcagctgcagaagcagccagagcctgctgcacaccaacggcttccagtacctggactggtacctgcagaagcccggccagagcccccagctgctgatctacctgggcagcaacagagccaccggcgtgccccacagattcagcggcagcggcagcggcaccgagttcaccctgaagatcagcagagtggaggccgaggacgtgggcgtgtactactgcatgcaggccaaggagagccccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31857 - RNA, 696 nt, synthetic construct
  misc_feature 1..696: note = derived and/or modified sequence opt4 from anti-HIV_3QEH_G-Chain
  source 1..696: mol_type = other RNA
caggtgcagctggtgcagagcggcgccgaggtgagaaagcccggcgccagcgtgaccgtgagctgcaagaccagcggctacaccttcgtgaacttctacatcgtgtgggtgagacaggcccccggccagggcctggagtggatgggcgtgatcaaccccttcagaggcgacacctacttcgcccagaagttcaagggcagagtgaccctgaccagagacaccagcaccagcaccgtgttcatggagctgagcagcctgagaagcgacgacaccgccatctactactgcgccagagacctggagatgagagacggcaacaaccacggcagccacctggagttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccac

SEQ ID NO: 31858 - RNA, 678 nt, synthetic construct
  misc_feature 1..678: note = derived and/or modified sequence opt4 from anti-HIV_2B1H_HeavyChain
  source 1..678: mol_type = other RNA
gagatccagctggagcagagcggcgccgaggtgaagaagagcggcgagagcctgaagatcagctgccagaccagcggctacagcttcagcgactactggatcggctgggtgagacagatgcccggcaagggcctggagtggatgggcatcttctaccccggcgacagcgacagcagatacagccccagcttcgagggccaggtgaccatgagcgccgacagaagcaccaacaccgcccacctgcagtggagcagcctgaagcccagcgacaccgccctgtactactgcgccagactgggcggcgactacgaggacagcggcgccgacgccttcgacttctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagc

SEQ ID NO: 31859 - RNA, 645 nt, synthetic construct
  misc_feature 1..645: note = derived and/or modified sequence opt4 from anti-HIV_2B1H_LightChain
  source 1..645: mol_type = other RNA
cagagcgtgctgacccagccccccagcgccagcggcacccccggccagagaatcagcatcagctgcagcggcaccagcagcaacgtggagaacaactacgtgtactggtaccagcacctgcccggcaccgcccccaagctgctgatctacagaaacgaccacagaagcagcggcatccccgacagattcagcgccagcaagagcggcaccagcgccagcctggccatcagcggcctgagacccgaggacgagggcgactactactgcgccgcctgggacgacagcagaggcggccccgactgggtgttcggcggcggcaccaagctgaccgtgctggcccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccacc

SEQ ID NO: 31860 - RNA, 648 nt, synthetic construct
  misc_feature 1..648: note = derived and/or modified sequence opt4 from anti-HIV_3TNM_B-Chain
  source 1..648: mol_type = other RNA
cagagcgtgctgacccagccccccagcgccagcggcagccccggccagagcgtgaccatcagctgcaccggcaccagcagcgacgtgggcggctacaactacgtgagctggtaccagcaccaccccggcaaggcccccaagctgatcatcagcgaggtgaacaacagacccagcggcgtgcccgacagattcagcggcagcaagagcggcaacaccgccagcctgaccgtgagcggcctgcaggccgaggacgaggccgagtactactgcagcagctacaccgacatccacaacttcgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 31861 - RNA, 693 nt, synthetic construct
  misc_feature 1..693: note = derived and/or modified sequence opt4 from anti-HIV_3TNM_A-Chain
  source 1..693: mol_type = other RNA
caggtgcagctgcaggagagcggccccggcctggtgaagcccagccagaccctgagcctgagctgcaccgtgagcggcggcagcagcagcagcggcgcccactactggagctggatcagacagtaccccggcaagggcctggagtggatcggctacatccactacagcggcaacacctactacaaccccagcctgaagagcagaatcaccatcagccagcacaccagcgagaaccagttcagcctgaagctgaacagcgtgaccgtggccgacaccgccgtgtactactgcgccagaggcaccagactgagaaccctgagaaacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacc

SEQ ID NO: 31862 - RNA, 690 nt, synthetic construct
  misc_feature 1..690: note = derived and/or modified sequence opt4 from anti-HIV_3UJJ_HeavyChain
  source 1..690: mol_type = other RNA
gaggtgcagctggtgcagagcggcgccgaggtgaagaagcccggcgagagcctgaagatcagctgcaaggccagcggctacagcttcagcagctactggatcgcctgggtgagacagatgcccggcaagggcctggagtggatgggcttcatctaccccgccgacagcgacaccagatacagccccagcttccagggccagggcaccatcagcgccgacaagagcatcagcaccgcctacctgcagtggagcagcctgaaggccagcgacaccgccatgtactactgcgccatcctgggcttctggggcgccaacagaggcggcggcggcatggacgtgtggggccagggcaccaccgtgatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacc

SEQ ID NO: 31863 - RNA, 639 nt, synthetic construct
  misc_feature 1..639: note = derived and/or modified sequence opt4 from anti-HIV_3UJJ_LightChain
  source 1..639: mol_type = other RNA
agctacgagctgacccagccccccagcgtgagcgtgagccccggccagaccgccagaatcacctgcagcggcgacgccctgcccgagaagtacgcctactggtaccagcagaagagcggccaggcccccgtgctgatcatctacgaggacagcaagagacccagcggcatccccgagagattcagcggcagcagaagcggcaccatggccaccctgaccatcagcggcgcccaggtggacgacgaggccgactactactgctacagcaccaacagcggcggcaccttcttcgtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgc

SEQ ID NO: 31864 - RNA, 669 nt, synthetic construct
  misc_feature 1..669: note = derived and/or modified sequence opt4 from anti-HIV_3UJI_HeavyChain
  source 1..669: mol_type = other RNA
caggtgcagctggtgcagagcgccgccgaggtgaagaagcccggcgaggccctgaagatcagctgcaagggcagcggctacagcttcagcaactactggatcgcctgggtgagacagatgcccggcaagggcctggagtggatgggcatcgtgtaccccgacgacagcgacagcagctacaacagcagcttccagggccagatcaccttcagcgccgacaagagcatcagcaccgcctacctgcactggaccagcctgcaggccagcgacaccgccatgtactactgcgccagactgggcttcgagggcgactacagcggcagcttcttcgactactggggccagggcaccctgctgatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccc

SEQ ID NO: 31865 - RNA, 627 nt, synthetic construct
  misc_feature 1..627: note = derived and/or modified sequence opt4 from anti-HIV_3UJI_LightChain
  source 1..627: mol_type = other RNA
agctacgagctgacccagccccccagcgtgagcgtgagccccggccagaccgccagcatcacctgcagcggcgacatcctgggcgacaagtacgtgagctggtaccagcagaagagcggccagagccccctgctggtgatctacgaggacaccaagagacccagcggcatccccgacagattcagcggcagcaagagcggcaacaccgccaccctgaccatcagcggcacccaggccatggacgaggccgactactactgccaggcctgggacagcaccctgggcgtggtgttcggcggcggcaccaaggtgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggccccc

SEQ ID NO: 31866 - RNA, 666 nt, synthetic construct
  misc_feature 1..666: note = derived and/or modified sequence opt4 from anti-HIV_2QSC_HeavyChain
  source 1..666: mol_type = other RNA
caggtgcagctggtgcagagcggcggcggcctggtgcagcccggcggcagcctgagactgagctgcgccgccttcggcttcaacttcagcagctacgtgatgcactgggtgagacaggcccccggccagggcctggagtacctgagcgccatcagcagcgacggcgagaccacctaccacgccaacagcgtgaagggcagattcaccagcagcagagacaacagcaagaacaccctgttcctgcagatgggcagcctgagaaccgaggacgtggccgtgtactactgcgccagagacagatactacgagaccagcggcagcaacgccttcgacgtgtggggccagggcaccatggtggtggtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggag

SEQ ID NO: 31867 - RNA, 645 nt, synthetic construct
  misc_feature 1..645: note = derived and/or modified sequence opt4 from anti-HIV_2QSC_LightChain
  source 1..645: mol_type = other RNA
aacagcgtgctgacccagagccccagcagcctgagcgccagcgtgggcgacagagtgaccatcacctgccaggccagccaggacatcagcaactacctgaactggtaccagcacaagcccggcaaggcccccaagctgctgatctacaccgccagcaacctggagaccggcgtgcccagcagattcagcggcggcggcagcggcacccacttcagcttcaccatcaccagcctgcagcccgaggacgccgccacctacttctgccagcagtacgacaacctgggcgacctgagcttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31868 - RNA, 690 nt, synthetic construct
  misc_feature 1..690: note = derived and/or modified sequence opt4 from anti-HIV_3MLZ_HeavyChain
  source 1..690: mol_type = other RNA
caggtgcagctgcaggagagcggccccggcctggtgaagcccagcgagaccctgagcctgacctgcaccgtgagcggcggcagcatcagcggcttccactggagctggatcagacagccccccggcaagggcctggagtacatcggctacatctactacagcggcagcaccagctacaaccccagcctgaagagcagagtgagcatgagcgtggacaccagcagaaaccagttcagcctggagctgagcagcgtgaccgccgccgacaccgccgtgtactactgcgccagagacttcggcgagtaccactacgacggcagaggcttccagtgcgagggcttcgacctgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31869 - RNA, 642 nt, synthetic construct
  misc_feature 1..642: note = derived and/or modified sequence opt4 from anti-HIV_3MLZ_LightChain
  source 1..642: mol_type = other RNA
cagagcgtgctgacccagccccccagcgtgagcgccgcccccggccagaaggtgaccatcagctgcagcggcagcagcagcaacatcggcaacaacatggtgagctggtaccagcagcaccccggcaccgcccccaagctgctgatctacgagaacagcaagagacccagcggcatccccgacagattcagcggcagcagaagcggcaccagcgccaccctgggcatcatcggcctgcagaccggcgacgaggccgagtactactgcgccacctgggacggcagcctgagaaccgtgttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgagagccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgc

SEQ ID NO: 31870 - RNA, 684 nt, synthetic construct
  misc_feature 1..684: note = derived and/or modified sequence opt4 from anti-HIV_3MLX_I-Chain
  source 1..684: mol_type = other RNA
caggtgcagctgcaggagagcggccccggcctggtgaagcccagcgagaccctgagcctgacctgcaccgtgagcggcggcagcatcagcggcttccactggagctggatcagacagccccccggcaagggcctggagtacatcggctacatctactacagcggcagcaccagctacaaccccagcctgaagagcagagtgagcatgagcgtggacaccagcagaaaccagttcagcctggagctgagcagcgtgaccgccgccgacaccgccgtgtactactgcgccagagacttcggcgagtaccactacgacggcagaggcttccagtgcgagggcttcgacctgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 31871 - RNA, 633 nt, synthetic construct
  misc_feature 1..633: note = derived and/or modified sequence opt4 from anti-HIV_3MLX_M-Chain
  source 1..633: mol_type = other RNA
agcgtgctgacccagccccccagcgtgagcgccgcccccggccagaaggtgaccatcagctgcagcggcagcagcagcaacatcggcaacaacatggtgagctggtaccagcagcaccccggcaccgcccccaagctgctgatctacgagaacagcaagagacccagcggcatccccgacagattcagcggcagcagaagcggcaccagcgccaccctgggcatcatcggcctgcagaccggcgacgaggccgagtactactgcgccacctgggacggcagcctgagaaccgtgttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgagagccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccacc

SEQ ID NO: 31872 - RNA, 684 nt, synthetic construct
  misc_feature 1..684: note = derived and/or modified sequence opt4 from anti-HIV_3MLW_I-Chain
  source 1..684: mol_type = other RNA
caggtgcagctggtgcagagcggcgccgaggtgaagaaggccggcgagagcctggagatcagctgcaagggcagcggctacaccttcaccgaccactggatcgcctgggtgagacaggtgcccggcaagggcctggagtggatgggcatgatctaccccggcgacagcgacaccagatacagccccagcctgcagggcagagtgaccatgagcgccgacaagaccctgagcaccgcctacctgcagtggagcagactggaggccagcgacaccgccatgtactactgcgccagactgcactacagcgacagaagcggcagctacttcaacgacgtgttccacatgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagc

SEQ ID NO: 31873 - RNA, 645 nt, synthetic construct
  misc_feature 1..645: note = derived and/or modified sequence opt4 from anti-HIV_3MLW_M-Chain
  source 1..645: mol_type = other RNA
cagagcgtgctgacccagccccccagcgccagcggcacccccggccagagagtgaccatcagctgcagcggcaacagcagcaacatcgagaacaactacgtgtactggtaccagcagctgcccggcagcacccccaagctgctgatcttcagagacgaccagagacccagcggcgtgcccgacagattcagcggcagcaagagcggcaccagcgccagcctggccatcagcggcctgagaagcgaggacgaggccgactactactgcgccagctgggacgacagcagaggcggccccgactacgtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccacc

SEQ ID NO: 31874 - RNA, 678 nt, synthetic construct
  misc_feature 1..678: note = derived and/or modified sequence opt4 from anti-HIV_3MLV_N-Chain
  source 1..678: mol_type = other RNA
gaggtgcagctggtggagagcggcggcgaggtgaagcagcccggccagagcctgaagatcagctgcaagagcagcggctacaacttcctggacagctggatcggctgggtgagacagatccccggcaagggcctggagtggatcggcatcatctaccccgacgacagcgacgcccactacagccccagcttcgagggccaggtgaccatgagcgtggacaagagcatcagcaccgcctacctgcagtggaccaccctgcaggccagcgacaccggcaagtacttctgcaccagactgtacctgttcgagggcgcccagagcagcaacgccttcgacctgtggggccagggcaccatgatcctggtgagcagcggcaccaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagc

SEQ ID NO: 31875 - RNA, 657 nt, synthetic construct
  misc_feature 1..657: note = derived and/or modified sequence opt4 from anti-HIV_3MLV_M-Chain
  source 1..657: mol_type = other RNA
agctacctgctgacccagccccccagcgtgagcgtgagccccggccagaccgccagcatcagctgcagcggcgacaagctggacgacaagtacgtgagctggtactaccagagacccggccagagccccgtgctgctgatgtaccaggacttcaagagacccagcggcatccccgagagactgagcggcagcaagagcggcaagaccgccaccctgaccatcagcggcacccagagcctggacgagggcgactactactgccaggcctgggacgccagcaccggcgtgagcggcggcggcaccaagctgaccgtgctgttcggcgagggcaccagactgaccgtgctggcccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccacc

SEQ ID NO: 31876 - RNA, 654 nt, synthetic construct
  misc_feature 1..654: note = derived and/or modified sequence opt4 from anti-HIV_3MLU_LightChain
  source 1..654: mol_type = other RNA
tacctgctgacccagccccccagcgtgagcgtgagccccggccagaccgccagcatcagctgcagcggcgacaagctggacgacaagtacgtgagctggtactaccagagacccggccagagccccgtgctgctgatgtaccaggacttcaagagacccagcggcatccccgagagactgagcggcagcaagagcggcaagaccgccaccctgaccatcagcggcacccagagcctggacgagggcgactactactgccaggcctgggacgccagcaccggcgtgagcggcggcggcaccaagctgaccgtgctgttcggcgagggcaccagactgaccgtgctggcccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccacc

SEQ ID NO: 31877 - RNA, 657 nt, synthetic construct
  misc_feature 1..657: note = derived and/or modified sequence opt4 from anti-HIV_3MLT_G-Chain
  source 1..657: mol_type = other RNA
agctacgacctgacccagccccccagcgtgagcgtgagccccggccagaccgccagcatcagctgcagcggcgacaagctggacgacaagtacgtgagctggtactaccagagacccggccagagccccgtgctgctgatgtaccaggacttcaagagacccagcggcatccccgagagactgagcggcagcaagagcggcaagaccgccaccctgaccatcagcggcacccagagcctggacgagggcgactactactgccaggcctgggacgccagcaccggcgtgagcggcggcggcaccaagctgaccgtgctgttcggcgacggcaccagactgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccacc

SEQ ID NO: 31878 - RNA, 666 nt, synthetic construct
  misc_feature 1..666: note = derived and/or modified sequence opt4 from anti-HIV_3GO1_HeavyChain
  source 1..666: mol_type = other RNA
gaggtgcagctgcaggagagcggccccggcctggtgaagcccagcgagaccctgagcctgacctgcaccgtgagcggcggccccatcaacaacgcctactggacctggatcagacagccccccggcaagggcctggagtacctgggctacgtgtaccacaccggcgtgaccaactacaaccccagcctgaagagcagactgaccatcaccatcgacaccagcagaaagcagctgagcctgagcctgaagttcgtgaccgccgccgacagcgccgtgtactactgcgccagagagtgggccgaggacggcgacttcggcaacgccttccacgtgtggggccagggcaccatggtggccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagccc

SEQ ID NO: 31879 - RNA, 627 nt, synthetic construct
  misc_feature 1..627: note = derived and/or modified sequence opt4 from anti-HIV_3GO1_LightChain
  source 1..627: mol_type = other RNA
agctacgtgctgacccagccccccagcgtgagcgtgagccccggccagaccgccagaatcacctgcagcgccgaggccctgagcaaccagtacgcctactggtacagacagagacccggccaggcccccctgctgatcatctacaaggacaccaagagacccagcggcatccccgagagattcagcggcagcaccagcggcaccaccgtgaccctgaccatcagcggcgtgcaggccgaggacgaggccgactactactgccagagcgccgacagcagcggcgactacgtgttcggcggcggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggccccc

SEQ ID NO: 31880 - RNA, 690 nt, synthetic construct
  misc_feature 1..690: note = derived and/or modified sequence opt4 from anti-HIV_4XCY_J-Chain
  source 1..690: mol_type = other RNA
caggtgcagctggtgcagagcggcgccgaggtgaagagacccggcagcagcgtgaccgtgagctgcaaggccagcggcggcagcttcagcacctacgccctgagctgggtgagacaggcccccggcagaggcctggagtggatgggcggcgtgatccccctgctgaccatcaccaactacgcccccagattccagggcagaatcaccatcaccgccgacagaagcaccagcaccgcctacctggagctgaacagcctgagacccgaggacaccgccgtgtactactgcgccagagagggcaccaccggctggggctggctgggcaagcccatcggcgccttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 31881 - RNA, 645 nt, synthetic construct
  misc_feature 1..645: note = derived and/or modified sequence opt4 from anti-HIV_4XCY_K-Chain
  source 1..645: mol_type = other RNA
gagatcgtgctgacccagagccccggcacccagagcctgagccccggcgagagagccaccctgagctgcagagccagccagagcgtgggcaacaacaagctggcctggtaccagcagagacccggccaggcccccagactgctgatctacggcgccagcagcagacccagcggcgtggccgacagattcagcggcagcggcagcggcaccgacttcaccctgaccatcagcagactggagcccgaggacttcgccgtgtactactgccagcagtacggccagagcctgagcaccttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 31882 - RNA, 630 nt, synthetic construct
  misc_feature 1..630: note = derived and/or modified sequence opt4 from anti-HIV_4YBL_C-Chain
  source 1..630: mol_type = other RNA
gtgctgacccagccccccagcgccagcggcagccccggccagagcgtgaccatcagctgcaccggcaccagcagcgacgtgggcggctacaactacgtgagctggtaccagcaccaccccggcaaggcccccaagctgatcatcagcgaggtgaacaacagacccagcggcgtgcccgacagattcagcggcagcaagagcggcaacaccgccagcctgaccgtgagcggcctgcaggccgaggacgaggccgagtactactgcagcagctacaccgacatccacaacttcgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggccccc

SEQ ID NO: 31883 - RNA, 672 nt, synthetic construct
  misc_feature 1..672: note = derived and/or modified sequence opt4 from anti-HIV_4YBL_B-Chain
  source 1..672: mol_type = other RNA
caggtgcagctgcaggagagcggccccggcctggtgaagcccagccagaccctgagcctgagctgcaccgtgagcggcggcagcagcagcagcggcgcccactactggagctggatcagacagtaccccggcaagggcctggagtggatcggctacatccactacagcggcaacacctactacaaccccagcctgaagagcagaatcaccatcagccagcacaccagcgagaaccagttcagcctgaagctgaacagcgtgaccgtggccgacaccgccgtgtactactgcgccagaggcaccagactgagaaccctgagaaacgccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaag

SEQ ID NO: 31884 - RNA, 630 nt, synthetic construct
  misc_feature 1..630: note = derived and/or modified sequence opt4 from anti-HIV_4R4N_X-Chain
  source 1..630: mol_type = other RNA
gacatccagatgacccagagccccagcttcgtgagcgccagcgtgggcgacagagtgaccatcacctgcagagccagccagggcatcagcagctacctggcctggtaccagcagaagcccggcaaggcccccaagctggtgatctacgccgccagcaccctgcagagcggcgtgcccagcagattcagcggcagcggcagcggcaccgagttcaccctgaccatcagcagcctgcagcccgaggacttcgccacctactactgccagcacctgatcggcctgagaagcttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 31885 - RNA, 660 nt, synthetic construct
  misc_feature 1..660: note = derived and/or modified sequence opt4 from anti-HIV_4R4B_F-Chain
  source 1..660: mol_type = other RNA
caggtgcagctgcagcagtggggcgccggcctgctgaagcccagcgagaccctgagcctgacctgcggcgtgtacggcgagagcctgagcggccactactggagctgggtgagacagccccccggcaagagactggagtggatcggcgagatcaagcacaacggcagccccaactaccaccccagcctgaagagcagagtgaccatcagcctggacatgagcaagaaccagttcagcctgaacctgaccagcgtgaccgccgccgacaccgccgtgtacttctgcgccagaagaagcaactggccctacctgcccttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 31886 - RNA, 750 nt, synthetic construct
  misc_feature 1..750: note = derived and/or modified sequence opt4 from anti-HIV_3JUY_D-Chain
  source 1..750: mol_type = other RNA
caggtgcagctggtgcagagcggcgccgaggtgaagaagcccggcgccagcgtgaaggtgagctgccaggccagcggctacagattcagccacttcaccgtgcactgggtgagacaggcccccggccagagattcgagtggatgggctggatcaacccctacaacggcaacaaggagttcagcgccaagttccaggacagagtgaccttcaccgccgacaccagcgccaacaccgcctacatggagctgagaagcctgagaagcgccgacaccgccgtgtactactgcgccagagtgggcgagtggggctgggacgacagcccctacgacaactactacatggacgtgtggggcaagggcaccaccgtgatcgtgagcagcggcggcggcggcagcggcggcggcggcagcggcggcggcggcagcgagatcgtgctgacccaggcccccggcaccctgagcctgagccccggcgagagagccaccttcagctgcagaagcagccacagcatcagaagcagaagagtggcctggtaccagcacaagcccggccaggcccccagactggtgatccacggcgtgagcaacagagccagcggcatcagcgacagattcagcggcagcggcagcggcaccgacttcaccctgaccatcaccagagtggagcccgaggacttcgccctgtactactgccaggtgtacggcgccagcagctacaccttcggccagggcaccaagctggagagaaag

SEQ ID NO: 31887 - RNA, 369 nt, synthetic construct
  misc_feature 1..369: note = derived and/or modified sequence opt4 from anti-HIV_4KG5_HeavyChain
  source 1..369: mol_type = other RNA
cagctggtgcagagcggccccgaggccaagagacccggcagcagcgtgaaggtgagctgcaaggccagcagagacaccttcaacaactacgtgctgaactgggtgagacaggcccccggccagggcctggagtggatgggcggcatcggccccatcatcgagaccgccgactacgccgagaagttcagaggcagactgagcatcaccgccgacgagagcaccaccaccgcctacatggagctgagcagcctgaccagcgacgacaccgccgtgtactactgcgccagaagcccctacagcagcctgaccgacacctactactactacatggacctgtggggcaagggcaccaccgtgaccgtgagcagc

SEQ ID NO: 31888 - RNA, 336 nt, synthetic construct
  misc_feature 1..336: note = derived and/or modified sequence opt4 from anti-HIV_4KG5_LightChain
  source 1..336: mol_type = other RNA
ctgacccagagccccgacagcctggccgtgagcctgggcgagagagccaccatcaactgcaagagcagccagagcatcctggacagcagcaacaacagaaactacctgacctggtaccagcagaagcccggccagccccccaagctgctgatctactgggccagcaccagagagagcggcgtgcccgacagattcagcggcagcggcagcagcaccgacttcaccctgaccatcagcagcctgcaggccgaggacgtggccgtgtactactgccagcagtacttcagcacccccggcatcaccttcggccagggcaccagactggagatcaagaga

SEQ ID NO: 31889 - RNA, 309 nt, synthetic construct
  misc_feature 1..309: note = derived and/or modified sequence opt4 from anti-HIV-1_LightChain
  source 1..309: mol_type = other RNA
gagatcgtgctgacccagagccccgccaccctgagcctgagccccggcgagagagccaccctgagctgcagagccagccagagcgtgtacaccaagctggcctggtaccagcagaagcccggccagccccccagactgctgatctacgacgccagcaacagagccgccggcatccccgccagattcagcggcagcggcagcggcaccgagttcaccctgaccatcaagagaatggagagagaggacttcgccgtgtactactgccagatcctggagttcttcggccagggcaccaccatcgacatgaac

SEQ ID NO: 31890 - RNA, 312 nt, synthetic construct
  misc_feature 1..312: note = derived and/or modified sequence opt4 from anti-HIV-1_LightChain
  source 1..312: mol_type = other RNA
gacatccagatgacccagagccccagcagcgtgagcgccagcgtgggcgacagagtgaccatcacctgcagagccagccagggcatcctgagcagccagctggcctggcaccagcagagaagaggccagccccccagactgctgatctacggcggcagcaacagagcccccggcatccccgagagattcaccggcagcggcagcggcaccgacttcgtgctgaccatcaagagactgcagagagacgacttcgccgtgtactactgccagatcctggagttcttcggcagaggcaccagagtggagatgaac

SEQ ID NO: 31891 - RNA, 312 nt, synthetic construct
  misc_feature 1..312: note = derived and/or modified sequence opt4 from anti-HIV-1_LightChain
  source 1..312: mol_type = other RNA
ggcctgctgctgacccagagccccggccccgtgagcttcttccccggcgagagagccaccgtgagctgcagagccagccacagcgtgaacagcgccgccatcaactggtaccagcagaagagaggccagccccccagactgatcatcgtggacggcagcaccagagccaccgccgtgcccgagagattcagcgccaccggcagcggcaccgagttcaccctggtgatcagcagactggagcccgaggacttcgccgtgtacttctgccagcacctgcagttcttcggcctgggcaccaaggtggacatcaag

SEQ ID NO: 31892 - RNA, 312 nt, synthetic construct
  misc_feature 1..312: note = derived and/or modified sequence opt4 from anti-HIV-1_LightChain
  source 1..312: mol_type = other RNA
gccttcgtgatgacccagagccccggcaccctggccctgagccccggcgagagagccaccctgagctgcagaaccagccaggagatcctgagcaaccagctggcctggcaccagcagagaagaggccagccccccagactgctgatctacggcggcagcaacagagcccccggcatccccgagagattcaccggcagcggcagcggcaccgacttcgtgctgaccatcaacagactggagagagacgacttcgccgtgtactactgccagatcctggagttcttcggcagaggcaccagagtggagatgaac

SEQ ID NO: 31893 - RNA, 312 nt, synthetic construct
  misc_feature 1..312: note = derived and/or modified sequence opt4 from anti-HIV-1_LightChain
  source 1..312: mol_type = other RNA
ggcatcgtgctgacccagagccccgacaccctgagcctgagccccggcgacagagccaccctgagctgcaagaccagccagagcatcgccagcgagcacctggcctggtaccagcagagacccggccagccccccagactgctgatcttcggcgccagcaacagagccagcggcatccccaccagattcagcggcagcggcagcggcgccgacttcaccctgagcatcaccagactggagcccgaggacttcgccgtgtactactgccagttcagcgagttcttcggcagaggcgccagagtggaggtgaag

SEQ ID NO: 31894 - RNA, 312 nt, synthetic construct
  misc_feature 1..312: note = derived and/or modified sequence opt4 from anti-HIV-1_LightChain
  source 1..312: mol_type = other RNA
cagttcgtgatgacccagagccccgccaccctgagcagcagccccggcggcaccgccaccctgagctgcagaaccagccacagcatcctgaacagccagctggcctggcaccagcagagaagaggccagcccctgagactgctgatctacggcgccagcaacagagcccccggcatccccgagagattcagcgccagcggcagcggcaccgagttcgtgctgaccatcaagagaatggagagagaggacttcgccgtgtactactgccagatcctggagttcttcggccagggcaccaccatcgacatgaac

SEQ ID NO: 31895 - RNA, 354 nt, synthetic construct
  misc_feature 1..354: note = derived and/or modified sequence opt4 from anti-HIV-1_HeavyChain
  source 1..354: mol_type = other RNA
agagtgcacctggtgcagagcggcacccaggtgaagaagcccggcgccagcgtgaaggtgagctgcgagaccagcggcttcaagttcctggacagcctgatccactgggtgagacaggcccccggccagggcctgtactggatgggctggatcaagccctacagaggcagcgtgaactacgacggctacttcagaggcagagtgagcatgaccagagacatctacaccgacaccgcctacctggagctgagcggcctgagaagcgacgacaccgccatctactactgcgccttcggcgccggcgacggctgggacctggtgtggggccagggcaccctggtgatcgtgagcagc

SEQ ID NO: 31896 - RNA, 354 nt, synthetic construct
  misc_feature 1..354: note = derived and/or modified sequence opt4 from anti-HIV-1_HeavyChain
  source 1..354: mol_type = other RNA
agagtgcacctggtgcagagcggcacccaggtgaagaagcccggcgccagcgtgaaggtgagctgcgagaccagcggcttcaagttcctggacagcctgatccactgggtgagacaggcccccggccagggcctgtactggatgggctggatcaagcccttcagaggcagcgtgaactacgacggctacttcagaggcagagtgagcatgaccagagacatctacaccgacaccgcctacatggagctgagcggcctgagaagcgacgacaccgccatctactactgcgccttcggcgccggcgacggctgggacctggtgtggggccagggcaccctggtgatcgtgagcagc

SEQ ID NO: 31897 - RNA, 354 nt, synthetic construct
  misc_feature 1..354: note = derived and/or modified sequence opt4 from anti-HIV-1_HeavyChain
  source 1..354: mol_type = other RNA
caggtgcacctggtgcagagcggcacccaggtgaagaagcccggcgccagcgtgagagtgagctgcgagaccagcggcttcaagttcctggacagcatcatccactggttcagacaggcccccggcgagggcctgttctggatgggctggatcaagccctacaccggcagcgtgaactacgtgagaagataccagggcagagtgagcatgaccagagacgtgtacagcgacaccgcctacatggacctgagcggcctgaacagcgacgacaccgccgtgtacttctgcacctacggcgccggcgacggctggaacctggtgtggggccagggcaccctggtgatcgtgagcgcc

SEQ ID NO: 31898 - RNA, 363 nt, synthetic construct
  misc_feature 1..363: note = derived and/or modified sequence opt4 from anti-HIV-1_HeavyChain
  source 1..363: mol_type = other RNA
caggtgagactggtgcagagcggcaaccaggtgagaaagcccggcgccagcgtgagaatcagctgcgaggccagcggctacaagttcatcgaccacttcatccactgggtgagacaggtgcccggccacggcctggagtggctgggctggatcaaccccagaggcggcggcgtgaactacagcagaggcttccagggcaagctgagcatgaccatgaccagagacaacttcgaggagaccgcctacctggacctgagcagactgaaccccggcgacaccgccgtgtactactgcgccagaggcttcgccggctacgagtggagcttcctgtggggccagggcaccctggtgatcgtgagcagc

SEQ ID NO: 31899 - RNA, 357 nt, synthetic construct
  misc_feature 1..357: note = derived and/or modified sequence opt4 from anti-HIV-1_HeavyChain
  source 1..357: mol_type = other RNA
caggtgagcctggtgcagagcggcaaccagctgaagaagcccggcgccagcgtgagaatcagctgcgagaccagcggctacaacttcctgaaccacttcatccactgggtgagacaggtgcccggccacggcctggagtggctgggctggatcaaccccagaggcggcggcgtgaactacagcagaaacttccagggcaaggtgagcctgaccagaaacatcgacatggagaccgtgtacctggacgtgagaggcctgacccccggcgacaccgccgtgtactactgcgccagaggcttcggcggcagcgactggaacttcgtgtggggccagggcaccagaatcaccgtgagcgcc

SEQ ID NO: 31900 - RNA, 357 nt, synthetic construct
  misc_feature 1..357: note = derived and/or modified sequence opt4 from anti-HIV-1_HeavyChain
  source 1..357: mol_type = other RNA
agaatcaacctgcaccagagcggcagccaggtgaagagaagcggcgccagcgtgagaatcagctgcgagaccagcggcttcaagttcatggacagccacctgcactgggtgagacaggtggccggccagggcttcgagtggatgggctggatcttcaccagcggcggcggcgtgaactacgccagacagttccagggcagactgaccctgaccagagacgtgttcaccgacaccgtgttcatggacctgagcggcgtgaacgtgggcgacaccggcgtgtactactgcgtgaagggcaccggcggcaacgagtggggcttcagctggggccagggcaccgtggtggtggtgagcccc

SEQ ID NO: 31901 - RNA, 357 nt, synthetic construct
  misc_feature 1..357: note = derived and/or modified sequence opt4 from anti-HIV-1_HeavyChain
  source 1..357: mol_type = other RNA
agaatcaacctggaccagagcggcagccaggtgaagaagagcggcgccagcgtgagaatcagctgcgagaccagcggcttcaagttcatggacagccacctgcactgggtgagacaggtggccggccagcccttcgagtggatgggctggatcttcaccagcggcggcggcgtgaactacgccagacagttccagggcagactgaccctgaccagagacgtgttcagcgagaccgtgttcatggacctgagcggcctgaacgccggcgacaccggcgtgtacttctgcgtgaagggcaccggcggcaacgagtggggcttcgtgtggggccagggcaccgtggtggtggtgagcccc

SEQ ID NO: 31902 - RNA, 357 nt, synthetic construct
  misc_feature 1..357: note = derived and/or modified sequence opt4 from anti-HIV-1_HeavyChain
  source 1..357: mol_type = other RNA
agaatcgagctgcaccagagcggcagccaggtgaagaagagcggcgccagcgtgagaatcagctgcgagaccagcggcttcaagttcatggacagccacctgcactgggtgagacaggtggccggccagagattcgagtggatgggctggatcttcaccagcggcggcggcgtgaactacgccagacagttccagggcagactgagactgaccagagacgtgttcagcgagagcgtgttcatggacctgagcggcctgaacagcggcgacaccggcgtgtactactgcgtgaagggcaccggcggcaacgagtggggcttcgtgtggggccagggcagcctggtggtggtgagcccc

SEQ ID NO: 31903 - RNA, 372 nt, synthetic construct
  misc_feature 1..372: note = derived and/or modified sequence opt4 from anti-HIV-1_HeavyChain
  source 1..372: mol_type = other RNA
caggccctggtgcagagcggcagccagatgaagaagcccggcgacagcgtgagactgagctgccagaccagcgacagcgccatcaccaagtacttcatccactggatcagacaggcccccggcaagggcctggagtggatcgcctggatcagcccctacggcggcagagtgaactacggctggcaggtgagagacagagccaccctgaccagaaacatccacatggagaccgtgtacatggacctgagaggcctgagacccgacgacaccgccacctactactgcgccatgagagactactgcagagacgacaactgcaacagatgggacctgggccactggggccagggcagcctgatcgtggtgagcgcc

SEQ ID NO: 31904 - RNA, 357 nt, synthetic construct
  misc_feature 1..357: note = derived and/or modified sequence opt4 from anti-HIV-1_HeavyChain
  source 1..357: mol_type = other RNA
caggtgaccctggtgcagagcggcaaccagctgaagagacccggcgccagcgtgagaatcagctgcgagaccagcggctacaacttcatggaccacttcatccactgggtgagacaggtgcccggccacggccccgagtggctgggctgggtgaaccccagaggcggcggcgtgaactacagcagaaagttccagggcagattcagcatgaccagagacgtgtacatggagaccgcctacctggacgtgaccggcctgagccccgccgacaccgccgtgtactactgcgccagaggcttcggcggcagcgactggagcttcctgtggggccagggcaccctgatcatcgtgagcagc

SEQ ID NO: 31905 - RNA, 324 nt, synthetic construct
  misc_feature 1..324: note = derived and/or modified sequence opt4 from anti-HIV-1_LightChain
  source 1..324: mol_type = other RNA
gagatcgtgctgacccagagccccggcaccctgagcctgagcgccggcgagagagccagcctgagctgcagagccagccagaccctgaacagcaacttcttcgcctggtaccaccagaagcccggccaggcccccagactgctgatctacggcgccagcaacagagccaccggcatccccgacagattcagcggcagcggcagcggcagcgacttcaccctgaccatcagcagactggagcccgaggacttcggcaagtactactgcgagcagtacgacgtgagccccagaaccttcggccagggcaccaaggtggagatcaag

SEQ ID NO: 31906 - RNA, 324 nt, synthetic construct
  misc_feature 1..324: note = derived and/or modified sequence opt4 from anti-HIV-1_LightChain
  source 1..324: mol_type = other RNA
gaggtggtgctgacccagagccccggcaccctgagcctgagccccggcgagagagccaccctgagctgcagagccagccagagcatcaacagcaacttcttcgcctggtaccaccagaagcccggccaggcccccagactgctgatctacggcgccagcagcagagccaccggcatccccgacagaatcagcggcaccggcagcggcgccgacttcaccctgaccatcaccggcctggagcccgaggacttcggcctgtactactgccagcagtacgacttcagccccagaaccttcggccagggcaccagagtggagatcaag

SEQ ID NO: 31907 - RNA, 324 nt, synthetic construct
  misc_feature 1..324: note = derived and/or modified sequence opt4 from anti-HIV-1_LightChain
  source 1..324: mol_type = other RNA
gaggtggtgctgacccagagccccggcaccctgagcctgagccccggcgagagagccaccctgagctgcagagccagccagaccatcaacagcaacttcttcgcctggtaccaccagaagcccggccaggcccccagactgctgatctacggcgccagcagcagagccaccggcatccccgacagaatcagcggcagcggcagcggcaccgacttcaccctgaccatcaccggcctggagcccgaggacttcggcctgtactactgccagcagttcgacttcagccccagaaccttcggccagggcaccagagtggagatcaag

SEQ ID NO: 31908 - RNA, 324 nt, synthetic construct
  misc_feature 1..324: note = derived and/or modified sequence opt4 from anti-HIV-1_LightChain
  source 1..324: mol_type = other RNA
gagatcgtgctgacccagagccccggcaccctgagcctggcccccggcgagagagccaccctgagctgcagagccagccagagcatcagcaccacctacctggcctggtaccagcagaagcccggccaggcccccagactgctgatctacgagaccagcagcagagccagcgacatccccgacagattcagcggcagcggcagcggcaccgacttcaccctgaccatcagcagactggagcccgaggacttcgccgtgtactactgccaccagtacgacagaagccccagaaccttcggccagggcaccaaggtggagatcaag

SEQ ID NO: 31909 - RNA, 336 nt, synthetic construct
  misc_feature 1..336: note = derived and/or modified sequence opt4 from anti-HIV-1_LightChain
  source 1..336: mol_type = other RNA
gacatcgtgatgacccagagccccgccagcctgagcgtgacccccggcgagaccgccagcatcagctgcaagtgcagcagaagcctgagagaggaggtgggctacaactacctggactggtacctgcagagacccggcaagagcccccagctgctgatctacgtgggcagcttcagagcccccggcgtgagcgagagattcagaggcagcggcgagcacaaggacttcaccctgaagatcgccagagtggagcccggcgacgccggcatctactactgcatgcagggcatcgacacccccagaaccttcggccagggcaccaccctggagatcaac

SEQ ID NO: 31910 - RNA, 321 nt, synthetic construct
  misc_feature 1..321: note = derived and/or modified sequence opt4 from anti-HIV-1_LightChain
  source 1..321: mol_type = other RNA
gacatccagatgacccagagccccagcagcctgagcgccagcgtgggcgacagagtgaccatcacctgcagagccagccaggccttcagaaacgacctgggctggtaccagcacaagcccggcaaggcccccgagagactgatctacgccaccagcaccctggagagcggcgtgcccagcagattcagcggcagcggcagcggcaccaacttcaccctgaccatcagcagcctgcaggccgaggacttcgccacctactactgcctgcagtacaacaccttccccagaaccttcggccagggcaccaaggtggagatcaag

SEQ ID NO: 31911 - RNA, 333 nt, synthetic construct
  misc_feature 1..333: note = derived and/or modified sequence opt4 from anti-HIV-1_LightChain
  source 1..333: mol_type = other RNA
aacttcatgctgacccagccccacagcgtgagcgagagccccggcaagaccgtgaccatcagctgcgccagaaccagaggcggcatcgacagcgcctacgtgcactggtaccagcagagacccggcagcgtgcccaccaccgtgatcttcgaggacaacagaagaccccccggcgtgcccgacagattcagcggcagcatcgacaccagcagcaacaccgccagcctgaccatcagcggcctgaagaccgaggacgaggccgactactactgccagagctacgacgacacctacttctgggtgttcggcggcggcaccaagctgaccgtgctg

SEQ ID NO: 31912 - RNA, 333 nt, synthetic construct
  misc_feature 1..333: note = derived and/or modified sequence opt4 from anti-HIV-1_LightChain
  source 1..333: mol_type = other RNA
aacttcatgctgacccagccccacagcgtgagcgagagccccggcaagaccgtgaccatcagctgcgccagaaccagaggcaccatcgacagcgcctacgtgcactggtaccagcagagacccggcgccgtgcccaccaccgtgatcttcgaggacgacagaagacccagcggcgtgcccgacagattcagcggcagcatcgacagcagcagcaacagcgccagcctgaccatcagcggcctgaagaccgaggacgaggccgactactactgccagagctacgacagcaactactactgggtgttcggcggcggcaccaagctgaccgtgctg

SEQ ID NO: 31913 - RNA, 396 nt, synthetic construct
  misc_feature 1..396: note = derived and/or modified sequence opt4 from anti-HIV-1_HeavyChain
  source 1..396: mol_type = other RNA
caggtgcagctgcagcagagcggccccgccctggtgaagcccagcgagaccctgagcctgacctgcagcgtgagcagcggcagagtgagcagctactactggagctggatcagacagagccccggcaagggcctggagtggatcggctacatccactacgaccccgacaccaacaccaactacagaacccactaccaccccagcctgagaggcagagtggtgatcagcgtggacagcagcaagagccaggtgagcctgaaggtgagaagcgtgaccgccgccgacagcgccctgtactactgcgccagacacagatacgacccctggagcaagggctacgacatcagaagccccttcgacttctggggccagggcaccctggtgaccgtgagcagc

SEQ ID NO: 31914 - RNA, 396 nt, synthetic construct
  misc_feature 1..396: note = derived and/or modified sequence opt4 from anti-HIV-1_HeavyChain
  source 1..396: mol_type = other RNA
caggtgcacctgcagcagagcggccccggcctggtgaagcccagcgagaccctgagcctgacctgcaccgtgagcggcggcagagtgagcagctactactggagctggatcagacagagccccggcaagggcctggagtggatcggctacatccactacgaccccgacaccagcaccaactacagaacccactaccaccccagcctgagaggcagagtggtgatcagcgtggacaccagcaagaaccaggtgagcctgaccgtgagaagcgtgaccgccgccgacagcgccctgtactactgcgccagacacagatacgacgtgtggagcaacggctacgacatcagaagcccctacgacttctggggcagaggcaccctggtgaccgtgagcagc

SEQ ID NO: 31915 - RNA, 396 nt, synthetic construct
  misc_feature 1..396: note = derived and/or modified sequence opt4 from anti-HIV-1_HeavyChain
  source 1..396: mol_type = other RNA
caggtgcacctggagcagagcggccccgccctggtgaagcccagcgagaccctgagcctgacctgcaccgtgagcggcggcagagtgagcagctactactggagctggatcagacagagccccggcaagggcctggagtggatcggctacatccactacgaccccgacaccagcaccaactacagaacccactaccaccccagcctgagaggcagagtggtgatcagcgtggacagcagcaagaaccaggtgagcctgaaggtgagaagcgtgaccgccgccgacagcgccctgtactactgcgccagacacagatacgacgtgtggagcaagggctacgacatcagaagccccttcgacttctggggcagaggcaccctggtgaccgtgagcagc

SEQ ID NO: 31916 - RNA, 390 nt, synthetic construct
  misc_feature 1..390: note = derived and/or modified sequence opt4 from anti-HIV-1_HeavyChain
  source 1..390: mol_type = other RNA
caggtggtgttccagaagcccggccccggcgtggtgaagcccagcgagaccctgagcctgacctgcaccgtgagcggcggcagagtgagaagctactactggagctggatcagactgccccccggccagggcctggagtggatcggctacatccactacgacgagaccaccgagtacaagagaagctacaaccccagcctgaagagcagaatcaccatcagcatggacaccagcaagaaccaggtgagcctgaagctgagcagcgtgaccgccgccgacgccgccgtgtactactgcgccagacacagatacgacagatggagcgacagctacgacatcagaagccccttcgacatctggggccagggcaccgtggtgaccgtgagcgcc

SEQ ID NO: 31917 - RNA, 396 nt, synthetic construct
  misc_feature 1..396: note = derived and/or modified sequence opt4 from anti-HIV-1_HeavyChain
  source 1..396: mol_type = other RNA
caggtgcagctgcagcagtggggcgccggcctgctgaagcccagcgagaccctgagcctgacctgcgccatctacggcagcagcttcagcggccactactggatgtggatcagacagagccccgccaagaccctggagtggatcgccgagatcaaccacaccggcggcaccagatacaaccccagcctggccagcagagtgagagtgttcagcgacaccagcaagaaccagttcagcctgaacatgaccagcctgaccgccgccgacaccggcatctactactgcgtgagaggccacctgagcagagacagactgggccagtacgccttctggagcggcgccctgatcgactacctggacccctggggccagggcaccctggtgaccgtgagcagc

SEQ ID NO: 31918 - RNA, 387 nt, synthetic construct
  misc_feature 1..387: note = derived and/or modified sequence opt4 from anti-HIV-1_HeavyChain
  source 1..387: mol_type = other RNA
caggtgcagctgcaccagtggggcgccggcctgctgaagcccagcgagaccctgagcctgacctgcgccgtgtacggcagcttcaccggcttccagtggacctgggtgagacagacccccggcaagggcctggagtggatcggcgagatcaaccacagcggcctgctggtgaccggcaagaccgactacaaccccagcctggagagcagagtgaccatcagcgtggacaccagcaagaaccagttcagcctgaagctgaccagcgtgaccgccgccgacaccggcgtgtactactgcgccagagccggcggcatgagcgactgggcctacccctactactacggcatggacgtgtggggccagggcaccatggtgaccgtgagcagc

SEQ ID NO: 31919 - RNA, 357 nt, synthetic construct
  misc_feature 1..357: note = derived and/or modified sequence opt4 from anti-HIV-1_HeavyChain
  source 1..357: mol_type = other RNA
caggtgcagctggtggagagcggcggcggcgtggtgcagcccggcagaagcctgaccctgagctgcgccaccagcggcttcgacttcagcagctacggcttccactgggtgagacaggcccccggcaagggcctgcagtgggtgagcatcatcagccacgacggcagcatcaagaactacggcgacagcatgaagggcagattcagcgtgagcagagacaacgccaaggacatcctgtacctgcagatgaacagcctgagacccgacgacaccgccctgtaccactgcgtgagaggcgacggcgagaacggcggcaccgactactggggcctgggcaccctggtgaccgtgagcgcc

SEQ ID NO: 31920 - RNA, 357 nt, synthetic construct
  misc_feature 1..357: note = derived and/or modified sequence opt4 from anti-HIV-1_HeavyChain
  source 1..357: mol_type = other RNA
caggtggacctggtggagagcggcggcggcgtggtgcagcccggcaagagcctgaagctgagctgcaccgccagcggcttcaccttcaccagctacggcatgcactgggtgagacagatccccggcaagggcctggagtgggtggccatcatcagccacgacggcaccatcaagaactacggcgacagcgtgaagggcagattcaccatcagcagagacaacgccatgaacatcctgtacctgcagatgaacaacctgagaggcgacgacaccgccctgtactactgcgtgagaggcgacggcgagaacggcggcaccgactactggggccagggcaccgtggtgaccgtgagcagc

SEQ ID NO: 31921 - RNA, 369 nt, synthetic construct
  misc_feature 1..369: note = derived and/or modified sequence opt4 from anti-HIV_V3_HeavyChain
  source 1..369: mol_type = other RNA
gaggtgcagctggtgcagagcggcgccgaggtgaagaagcccggcgagagcctgaagatcagctgccagggcttcggctacaccttcagcacctactggatcggctgggtgagacagatgcccggcaagggcctggagtggctgggcatcatctaccccgaggacagcgagaccatctacagccccagcttccagggccaggccaccatcagcgccgacaagagcctgagcaccgcctacctgcagtggagcggcctgagagccagcgacagcgccatctactactgcgccagactgggctactgcggcagcaccagctgcagcttcttcgacttctggggcagaggcaccctggtgaccgtgagcagc

SEQ ID NO: 31922 - RNA, 369 nt, synthetic construct
  misc_feature 1..369: note = derived and/or modified sequence opt4 from anti-HIV_V3_HeavyChain
  source 1..369: mol_type = other RNA
gaggtgcagctggtgcagagcggcgccgaggtgaccaagcccggcgagagcctgaagatcagctgcaagggcagcggctacagcttcagcacccactggatcgcctgggtgagacagatgcccggcagaggcctggagtggatgggcttcatctaccccgacgacagcgacaccagatacagccccagcctgcagggccacgtgatcatcagcgccgacaagagcctgagcaccgcctacctgcagtggagcagcctgaaggccagcgacaccgccatgtactactgcgccagactgggcggcgacgagtaccagagcagcggcggcatggacgtgtggggccagggcaccaccgtgatcgtgagcagc

SEQ ID NO: 31923 - RNA, 393 nt, synthetic construct
  misc_feature 1..393: note = derived and/or modified sequence opt4 from anti-HIV_V3_HeavyChain
  source 1..393: mol_type = other RNA
gaggtgcagctggtgcagagcggcgccgaggtgaagaagcccggcgccaccgtgaagatcagctgcaaggtgagcggctacaccctgaccgactactacatccactgggtgcagcaggcccccggcagaggcctggagtggctgggcctggtggaccccgagaacggcgagaccctgtacgccgagaagttccagggcagagtgaccctgaccgccgacaccagcaccgacaccgcctacatggagctgaagagcctgagatacgaggacaccgccgtgtactactgcgccaccgagggcccccccagctactacgacagcggcacctacgccaagagcctgcccgccagcttcgcctgctggggccagggcaccctggtgaccgtgagcagc

SEQ ID NO: 31924 - RNA, 369 nt, synthetic construct
  misc_feature 1..369: note = derived and/or modified sequence opt4 from anti-HIV_V3_HeavyChain
  source 1..369: mol_type = other RNA
caggtgcagctgcaggagagcggccccggcctggtgaagcccagcgagaccctgagcctgacctgcaccgtgagcggcggcagcatcaacaactactactggagctggatcagacagccccccggcaagggcctggagtacatcggctacatcttctacagcggcagcaccaactacaaccccagcctgaagagcagagtgaccttcagcgtggacaccagcaagaaccagttcagcctgaagctgaccagcgtgaccgccaccgacaccgccgtgtactactgcgccagaggccccctgctgtacttcggcgcccccagaacccacttcgactactggggccagggcgccctggtgaccgtgagcagc

SEQ ID NO: 31925 - RNA, 372 nt, synthetic construct
  misc_feature 1..372: note = derived and/or modified sequence opt4 from anti-HIV_V3_HeavyChain
  source 1..372: mol_type = other RNA
gaggtgcagctggtgcagagcggcgccgaggtgaagaagcccggcgagagcctgaagatcagctgcaagggcagcggctacagcttcagcagccactggatcggctgggtgagacagctgcccggcaagggcctggagtggatgggcatcatctaccccgacgacagcgacaccaagtacaaccccagcttccagggccaggtgaccatcagcgccgacagaagcatcagcaccgcctacctgcagtggagcagcctgaaggccagcgacaccgccatgtactactgcgccagagtgggctacgacagctacggctacagcggcagcaacttcgacgagtggggccagggcaccctggtgaccgtgagcagc

SEQ ID NO: 31926 - RNA, 357 nt, synthetic construct
  misc_feature 1..357: note = derived and/or modified sequence opt4 from anti-HIV_V3_HeavyChain
  source 1..357: mol_type = other RNA
gaggtgcagctggtgcagagcggcgccgaggtgaagaagcccggcgagagcctgaagatcagctgcaagggcagcggctacaacttcaacagcgactggatcggctgggtgagacagatgcccggcaagggcctggagtgggtgggcatgatctaccccgacgacttcgaggtgagacacagcccccccttccagggcagagtgaccatgagcgtggacaagagcatcagcaccgcctacctgcagtggagcagcctgaagagcagcgacaccggcatgtacttctgcgccagactggacggcaacgccgccgccttcgactactggggccagggcacccaggtgaccgtgagcagc

SEQ ID NO: 31927 - RNA, 360 nt, synthetic construct
  misc_feature 1..360: note = derived and/or modified sequence opt4 from anti-HIV_V3_HeavyChain
  source 1..360: mol_type = other RNA
gacgtgcagctggtgcagagcggcgccgaggtgaagaaggccggcgagagcctgaagatcagctgcagacccagcggctacaacttcgccgactactggatcggctgggtgagacagatgcccggcaagggcctggagtggatgggcatcatcttccccgacgacagcgacaccagatacggccccagcttcgagggccaggtgaccatcagcgccgacaagagcatcaacaccgcctacctgcagtggaacagcctgaaggccagcgacaccgccatgtacttctgcgccagacacggcggcagcggcgccgcccccggcgactactggggccagggcaccctggtgaccgtgagcagc

SEQ ID NO: 31928 - RNA, 363 nt, synthetic construct
  misc_feature 1..363: note = derived and/or modified sequence opt4 from anti-HIV_V3_HeavyChain
  source 1..363: mol_type = other RNA
gaggtgcagctggtgcagagcggcgccgaggtgaagaagcccggcgccaccgtgaagatcagctgcaaggtgagcggctacaccttcaccgactacttcatgcactgggtgcaggaggcccccggcaagggcctggcctggatgggcctggtggaccccgagaacggcgacaccgtgtacgccgagaagctgcagggcagagtgaccatgagcgccgacaccagcagagacaccgcctacatggagctgaccagcctgagaagcgaggacaccgccgtgtactactgcgccatcggcaagagcgtggccggcaccagcgcctacgacatctggggccagggcaccatggtgaccgtgagcagc

SEQ ID NO: 31929 - RNA, 369 nt, synthetic construct
  misc_feature 1..369: note = derived and/or modified sequence opt4 from anti-HIV_V3_HeavyChain
  source 1..369: mol_type = other RNA
caggtgcagctggtgcagagcggcgccgaggtgagaaagcccggcgccagcgtgaaggtgagctgcaaggccagcggcgacaccttcaacaaccacgacatcaactgggtgagacaggcccccggccagggccccgagtgggtgggctggatgaaccccaagagcggcaacgccggctacgcccagaagttccagggcagagtgaccatgaccagagacaccagcatcagcaccgcctacatggagctgagaagcctgaccagcgaggacaccggcgtgtactactgcgccagactgaccgtggactgcgacgacggcggctgctacggcgactactggggccagggcaccctggtgaccgtgagcagc

SEQ ID NO: 31930 - RNA, 354 nt, synthetic construct
  misc_feature 1..354: note = derived and/or modified sequence opt4 from anti-HIV_V3_HeavyChain
  source 1..354: mol_type = other RNA
gaggtgtacctgcagcagagcggcgccgagctgaaggagcccggcgccaacgtgaagatcagctgcaaggccttcggcttcatcttcaccgactacttcatccactggctgagacaggcccccggcaagggcccccagtgggtgggcgtggtggaccccgaggacggcagcaccacctacgccgaggccttccagggcagagtgagcatcaccgccgacagaagcaccgacaccgcctacatggacctggccggcctgaccagcgacgacaccgccgtgtactactgcgccctgatgtggaacgagagcggccccgacaactggggccagggcaccctggtgatcgtgagcagc

SEQ ID NO: 31931 - RNA, 393 nt, synthetic construct
  misc_feature 1..393: note = derived and/or modified sequence opt4 from anti-HIV_V3_HeavyChain
  source 1..393: mol_type = other RNA
gaggtgcaggtggtggagttcggcggcgaggtgaagaagcccggcgccagcgtgaaggtgagctgcgaggccagcggctacaccttcgccaagttcgccatccactgggtgagacaggcccccagacagggcctggagtggatgggctggatcaacggcgacgacggcaagaccgagtacagccagaagttccaggacagagtgaccatgaccagagacaccagcgccagcaccgtgtacatggagctgagcagcctgagaagcgaggacaccgccctgtactactgcgccagagccatgtaccccgacaccgtgaccggcaacgacaaccccgcccccccccccttcgagggcgactactggggccagggcaccctggtgaccgtgagcagc

SEQ ID NO: 31932 - RNA, 393 nt, synthetic construct
  misc_feature 1..393: note = derived and/or modified sequence opt4 from anti-HIV_V3_HeavyChain
  source 1..393: mol_type = other RNA
gaggtgcagctggtggagagcggcggcggcctggtgaagcccggcggcagcctgagactgacctgcgtggccagcggcttcaccttcagcgacgtgtggctgaactgggtgagacaggcccccggcaagggcctggagtgggtgggcagaatcaagagcagaaccgacggcggcaccaccgactacgccgccagcgtgaagggcagattcaccatcagcagagacgacagcaagaacaccctgtacctgcagatgaacagcctgaagaccgaggacaccgccgtgtacagctgcaccaccgacggcttcatcatgatcagaggcgtgagcgaggactactactactactacatggacgtgtggggcaagggcaccaccgtgaccgtgagcagc

SEQ ID NO: 31933 - RNA, 387 nt, synthetic construct
  misc_feature 1..387: note = derived and/or modified sequence opt4 from anti-HIV_CD4bs_HeavyChain
  source 1..387: mol_type = other RNA
gaggagcagctggtggagagcggcggcggcctggtgaagcccggcggcagccagagactgagctgcgccgccagcgagttcaccttcagcagatacaccatgaactgggtgagacaggcccccggcaagggcctggagtgggtgagcagcatcagcggcaacgacaacaacatctactacgccgacagcgtgaagggcagattcaccatcagcagagacaacgccagaaacagcctgtacctgcagatcaacagcctgagagtggaggacaccgccgtgtactactgcgccagaggccccctggacagctacgacttctggagcggcagcagacactactacggcctggacgtgtggggccagggcaccaccgtgaccgtgagcagc

SEQ ID NO: 31934 - RNA, 372 nt, synthetic construct
  misc_feature 1..372: note = derived and/or modified sequence opt4 from anti-HIV_CD4bs_HeavyChain
  source 1..372: mol_type = other RNA
caggtgcagctggtgcagagcggcagcgagctgaagaagcccggcgccagcgtgaaggtgagctgcaaggccagcggctacaccttcaccagccacatcatcaactgggtgagacaggcccccggccagggcctggagtggatgggctggatcaacaccaacaccggcaaccccacctacgcccagggcttcaccggcagattcgtgttcagcctggacaccagcgtgagcatggcctacctgcagatcagcagcctgaaggccgaggacaccggcgtgtactactgcgccagaggcttcagacagtggctggtggccagaatcacctacttcgactactggggccagggcaccctggtgaccgtgagcagc

SEQ ID NO: 31935 - RNA, 369 nt, synthetic construct
  misc_feature 1..369: note = derived and/or modified sequence opt4 from anti-HIV_CD4bs_HeavyChain
  source 1..369: mol_type = other RNA
gagctgagactgcaggccagcggccccggcctggtgaagcccagcgagaccctgagcctggtgtgcagcgtgagcggcgtgagcatcagcgacagctactggaactggatcagacagcccgccggcaagggcctggagtggatcggcagagtgtacaccagaggcacccacacctacaaccccagcctgggcggcagagccaccgtgagcggcgacaccaacaagaacgaggtgagcctgaagctgatgagcgtgaccgccgccgacaccgccgtgtactactgcgccagagccctgagcggcgactggaccagaagatacttctacatggacgtgtggggcagaggcacccccgtgaccgtgagcagc

SEQ ID NO: 31936 - RNA, 381 nt, synthetic construct
  misc_feature 1..381: note = derived and/or modified sequence opt4 from anti-HIV_CD4bs_HeavyChain
  source 1..381: mol_type = other RNA
cagctgcagctgcaggagagcggccccagactggtgaagcccagcgagaccctgagcctgacctgcaccgtgagcggcggcagcatcagcagcggcgactactactggacctggatcagacagccccccggcgagggcctggagtacatcggctacatctacagcggcggcagcaccgactacaaccccagcctgaagagcagagccagcatcagccaggacaccagcaccaacgagttcagcctgaagctgaccagcgtgaccgccgccgacaccgccgtgtacttctgcgccagagacagaagagtgctgctgtggttcggcgagcccagaagaggcctggacttctggggccccggcaccctggtgaccgtgagcagc

SEQ ID NO: 31937 - RNA, 396 nt, synthetic construct
  misc_feature 1..396: note = derived and/or modified sequence opt4 from anti-HIV_CD4bs_HeavyChain
  source 1..396: mol_type = other RNA
gaggtgcagctggtggagagcggcggcggcctggtgaagcccggcggcagcctgagactgagctgcgccgccagcggcttcaccttcagcagcgcctggatgagctgggtgagacaggcccccggcaagggcctggagtgggtgggcagaatcaagagcaagagcgacggcgagaccaccgactacgccgcccccgtgaagggcagattcaccatcagcagagacaacctggagagcaccctgtacctgcagctgaacagcctgaagaccgaggacaccgccgtgtactactgcgccaccgccacccccagctactacgacatcatgaccggcaactacaagtactactactacatggacgtgtggggcaagggcaccaccgtgaccgtgagcagc

SEQ ID NO: 31938 - RNA, 363 nt, synthetic construct
  misc_feature 1..363: note = derived and/or modified sequence opt4 from anti-HIV_CD4bs_HeavyChain
  source 1..363: mol_type = other RNA
caggtgcagctggtggagagcggcggcggcctggtgaagcccggcggcagcctgagactgagctgcgccgccagcggcttcatcttcagagaccactacatgacctggatcagacaggcccccggcaagggcctggagtgggtgagctacatcagcagcagcagcaacaacatccagtacgccgacagcgtgaagggcagattcaccgtgagcagagacaacgccaagaacagcctgtacctgcagatgaacagcctgagagccgacgacaccgccgtgtactactgcgccagaagcggccccttctacaactacggcccccccaacaactggggccagggcaccctggtgaccgtgagcagc

SEQ ID NO: 31939 - RNA, 378 nt, synthetic construct
  misc_feature 1..378: note = derived and/or modified sequence opt4 from anti-HIV_CD4bs_HeavyChain
  source 1..378: mol_type = other RNA
caggtgcagctggtggagagcggcggcggcgtggtgcagcccggcggcagcctgaccctgagctgcaccgccagcggcttccccttcaacagctacgccatgcactgggtgagacaggcccccggcaagggcctggagtgggtgagcatgaccagccacgacggcggcaacaaggacttcgtggacagcgtgaagggcagattcaccatcagcagagacaacagcagaaacaccctgttcctgcagatgaacagcctgagccaggacgacaccggcgtgtactactgcgtgagaggcaagctggaggactacaacttctggggccactacagagacttcgacagctggggccagggcaccctggtgaccgtgagcgcc

SEQ ID NO: 31940 - RNA, 405 nt, synthetic construct
  misc_feature 1..405: note = derived and/or modified sequence opt4 from anti-HIV_CD4bs_HeavyChain
  source 1..405: mol_type = other RNA
gagccccacgtggtggagagcggcggcggcatggccaagcccggcggcagcctgagactgagctgcgccggcagcggcttcaccttcaccaacgcctggatgaactgggtgagacaggcccccggcaagggcctggagtgggtgggcctgatcaagagcaagagcgacggcggcaccaccgactacgccgccgacgtggagggcagattcaccatcagcagagacgacctggagagcaccatgttcctggagatgcacagcctgcagatcgaggacaccgccgtgtacttctgcaccacccagtaccccagatactacgacctgatgaccggcaactacaagagaagatacttcagcagcggcatggacgtgtggggccagggcaccgccgtgaccgtgagcagc

SEQ ID NO: 31941 - RNA, 384 nt, synthetic construct
  misc_feature 1..384: note = derived and/or modified sequence opt4 from anti-HIV_CD4bs_HeavyChain
  source 1..384: mol_type = other RNA
caggtgcagctgcaggagagcggccccggcctggtgaagcccagccagaccctgagcctgacctgcaccgtgagcggcgacagcgtgagcagcggcaactactactggagctggatcagacagcccgccggcaagcccctggagtggatcggccacatcagcaccggcggcggcaccaagaacaaccccagcctgcagagcagagtgaccatcagcctggacagcagcaagaaccaggtgagcctgagcctgagcagcgtgaccgccgccgacaccgccgtgtacacctgcgccagaggcccccccagaagcctgtggttcggcgaccccacctacagctacatggacgtgtggggcaagggcaccaccgtgaccgtgagcagc

SEQ ID NO: 31942 - RNA, 372 nt, synthetic construct
  misc_feature 1..372: note = derived and/or modified sequence opt4 from anti-HIV_CD4bs_HeavyChain
  source 1..372: mol_type = other RNA
caggtgcagctggtgcagagcggcgccgaggtgaagaagcccggcagcagcgtgaaggtgagctgcaaggccagcggcggcaccttcaacagccacgccttcacctgggtgagacaggcccccggccagggcctggagtggatgggcggcatcatccccaccctgggcctggccaacgacgcccagaagttccagggcagattcaccatcaccgccgacgagagcaccaccaccgtgtacatggagctgagcagcctgagaagcgaggacaccgccgtgtactactgcgccagaagaccctactacgaccaggtgagcggcgtgggcgccttcgacatctggggccagggcaccagagtgaccgtgagcagc

SEQ ID NO: 31943 - RNA, 390 nt, synthetic construct
  misc_feature 1..390: note = derived and/or modified sequence opt4 from anti-HIV_V2_HeavyChain
  source 1..390: mol_type = other RNA
caggtgcagctggtgcagagcggcgccgaggtgaagaagcccggcagcagcgtgaaggtgagctgcgaggccagcggcgtgaccagcagcagctacaccatcagctgggtgagactggcccccggccagggcctggagtggatgggcagaatcacccccatcttcgacatcaccaactacgcccagaagttccagggcagagtgaccctgaccgccgacaagagcaccggcaccacctacatggagctgagcagcctgagaagcgacgacaccgccgtgtactactgcgccagagacaagagcgacgtggtggtggtgaccagcatcagacccgcctactactacggcatggacgtgtggggccagggcaccaccgtgaccgtgagcagc

SEQ ID NO: 31944 - RNA, 366 nt, synthetic construct
  misc_feature 1..366: note = derived and/or modified sequence opt4 from anti-HIV_V2_HeavyChain
  source 1..366: mol_type = other RNA
caggtgcagctggtgcagagcggcgccgaggtgaagaagcccggcagcagcgtgaaggtgagctgcaaggccagcggcggcaccttcagaagctacgccatcagctgggtgagacaggcccccggccagggcctggagtggatgggcggcatcatccccatcttcggcaccgccgactacgcccagaagttccagggcaaggtgaccatcaccgccgacgagagcaccagcaccgcctacatggagctgagcagcctgaccagcgaggacaccgccatgtactactgcgccagaagcagagaccacttcttcgacaccagagtgttccagggctggggccagggcaccctggtgaccgtgagcagc

SEQ ID NO: 31945 - RNA, 363 nt, synthetic construct
  misc_feature 1..363: note = derived and/or modified sequence opt4 from anti-HIV_V2_HeavyChain
  source 1..363: mol_type = other RNA
caggtgcagctggtgcagagcggcgccgaggtgaagaagcccggcagcagcgtgaaggtgagctgcaaggccagcggcggcaacttcaacacctacaccatcagctgggtgagacaggcccccggccagggcctggagtggatgggcagaatcatccccatcttcggcatcgtgaaccccgcccagaagttccccggcagagtgaccatcaacgtggacaagagcaccaacaccgcctacatggagctgagcagcctgagaagcgaggacaccgccgtgtactactgcgccaccagcggcgtgggcctgcacttcggctacttcgactactggggccagggcacccaggtgaccgtgagcagc

SEQ ID NO: 31946 - RNA, 378 nt, synthetic construct
  misc_feature 1..378: note = derived and/or modified sequence opt4 from anti-HIV_V2_HeavyChain
  source 1..378: mol_type = other RNA
caggtgcagctgcagcagtggggccccggcctgctgaagcccagcgagaccctgagcctgacctgcgccgtgtacggcggcagcttcggcagatactactggagctggatcagacagagcagcggcgagggcctggagtggctgggccagatcgaccacaccggcagcaccacctacaaccccagcctgaagggcagagtgaccatcagcatcgacagcagcaccaaccagttcagcctgaaggtgaccagcgtgatcgccgccgacaccgccgtgtactactgcgccagagcccccagcggctaccccggcgtgagcctgtaccagtactacggcctggacgtgtggggccagggcaccaccgtgaccgtgagcccc

SEQ ID NO: 31947 - RNA, 366 nt, synthetic construct
  misc_feature 1..366: note = derived and/or modified sequence opt4 from anti-HIV_V2_HeavyChain
  source 1..366: mol_type = other RNA
caggtgcagctggtgcagagcggcgccgaggtgaagaagcccggcagcagcgtgaaggtgagctgcaaggccagcggcggcaccttcagcaactacgccatcagctgggtgagacaggcccccggccagggcctggagtggatgggcggcatcatccccatcttcggcaccaccgactacgcccagaagttccagggcagagtgaccatcaccgccgacgccagcaccagcaccgcctacatggagctgagcagcctgagaagcgacgacaccgccgtgtactactgcgccagaagcagaggccactacttcgacaccagagtgttcgagggctggggccagggcaccctggtgaccgtgagcagc

SEQ ID NO: 31948 - RNA, 372 nt, synthetic construct
  misc_feature 1..372: note = derived and/or modified sequence opt4 from anti-HIV_V2_HeavyChain
  source 1..372: mol_type = other RNA
caggtgcacctggtgcagagcggcaccgaggtgaagaagcccggcgccagcgtgaccgtgagctgcaaggccagcggctacagcttcaccggctactacctgcactgggtgagacaggcccccggccagggcctggagtggatgggctggatcaaccccaacagcggcggcacctactacgcccagaacttccaggccagagtgaccatgaccagagacaccagcatcagcaccgtgtacatggacctgagcagactgagaagcgacgacaccgccgtgtactactgcgtgagaagagccgtgctgaccgccctgccccccagatactacttcgacttctggggccagggcaccctggtgaccgtgagcagc

SEQ ID NO: 31949 - RNA, 318 nt, synthetic construct
  misc_feature 1..318: note = derived and/or modified sequence opt4 from anti-HIV_V3_LightChain
  source 1..318: mol_type = other RNA
agcctggagctgacccagccccccagcgtgagcgtgagccccggccagaccgtgagcatcacctgcagcggcaacctgctgggcgacaaggacgccagctggtaccagctgaagcccggccagagccccatcctggtgatctacctggacaccgagagacccagcggcatccccgagagattcagcggcagcaagagcggcaacaccgccaccctgaccatcagcggcacccaggccatggacgaggccgagtacttctgccaggcctgggacaccaccaccgtgctgttcggcggcggcaccagactgaccgtgctg

SEQ ID NO: 31950 - RNA, 324 nt, synthetic construct
  misc_feature 1..324: note = derived and/or modified sequence opt4 from anti-HIV_V3_LightChain
  source 1..324: mol_type = other RNA
agcgacgagctgacccagccccccagcgtgagcgtgagccccggccagaccgccagaatcacctgcagcggcgacgccctgcccgagaagtacgcctactggtaccagcagaagagcggccaggcccccgtgctggtgatcgacgaggacaacaagagacccttcggcacccccgagagattcagcggcagcagaagcggcaccatggccaccctgaccatcaccggcgcccagatggaggacgaggccgactactactgcagcagcaccgacagcagaggcacctactgggtgttcggcggcggcaccaagctgaccgtgctg

SEQ ID NO: 31951 - RNA, 336 nt, synthetic construct
  misc_feature 1..336: note = derived and/or modified sequence opt4 from anti-HIV_V3_LightChain
  source 1..336: mol_type = other RNA
cagagcgtgctgacccagccccccagcgtgagcgccgcccccggccagaaggtgaccatcagctgcagcgccggcaacagcaagatcggcgacaactacatcagctggtaccagcacgtgcccggcgccgcccccaagctgctgatctacgagaacgacaagagacccagcggcatccccgacagattcagcggcagcaagagcggcaccagcgccagcctgggcatcaccggcctgcagaccggcgacgaggccgactactactgcgccgcctgggacaacagcctgagcagcgccctgtacgtgttcggcaccggcaccaaggtgaccgtgctg

SEQ ID NO: 31952 - RNA, 339 nt, synthetic construct
  misc_feature 1..339: note = derived and/or modified sequence opt4 from anti-HIV_V3_LightChain
  source 1..339: mol_type = other RNA
gacatcgtgatgacccagagccccgacagcctggccgtgagcctgggcgagagagccaccatcaactgcaagagcagccagaacgtgttctacagcagcaacaacagaaactacctggcctggtaccagcagagacccggccagccccccaagctgctgttctactgggccagcaccagagagagcggcgtgcccgacagattcagcggcagcggcagcggcaccgacttcaccctgaccatcagcagcctgcagaccgaggacgtggccatctactactgccagcagtactacaacaccccccccaccttcggccccggcaccaaggtggagatcaag

SEQ ID NO: 31953 - RNA, 318 nt, synthetic construct
  misc_feature 1..318: note = derived and/or modified sequence opt4 from anti-HIV_V3_LightChain
  source 1..318: mol_type = other RNA
agctacgagctgacccagccccccagcgtgagcgtgagccccggccagaccgccaccatcacctgcagcggcgacctgctgggcgacaagtacgccagctggtacagacagaagcccggccagagccccgtgctggtgatctacgaggacaccaagagacccagcggcctgcccgagagattcagcggcagcaacagcggcaacaccgccaccctgaccatcagcgagacccaggccatggacgaggccgactactactgccaggcctgggacaccagaaccgtggtgttcggcggcggcaccaagctgaccgtgctg

SEQ ID NO: 31954 - RNA, 327 nt, synthetic construct
  misc_feature 1..327: note = derived and/or modified sequence opt4 from anti-HIV_V3_LightChain
  source 1..327: mol_type = other RNA
cagagcgtgctgacccagccccccagcgtgagcgccgcccccggccagaaggtgaccatcagctgcagcggcagaagcagcgacatcgagaacaagttcgtgagctggtaccagcagctgcccggcaccgcccccaagctgctgatctacgaggacaacaagagacccagcggcatccccgacagattcagcggcagcaagagcggcaccagcgccaccctgggcatcaccggcctgcagaccggcgacgaggccgactactactgcggcacctgggacaacaacctgagagccggcttcggcggcggcacccacctgaccgtgctg

SEQ ID NO: 31955 - RNA, 324 nt, synthetic construct
  misc_feature 1..324: note = derived and/or modified sequence opt4 from anti-HIV_V3_LightChain
  source 1..324: mol_type = other RNA
agctacgagctgacccagccccccagcgtgagcgtgagccccggccagaccgccagaatcacctgcagcggcgacgccctgcccaacaagtacgccttctggtaccagcagaagagcggccaggcccccgtgctggtgatcttcgacgacaacagaagacccgccggcatccccgagagattcagcggcagcagaagcggcaccctggccaccctgaccatcagcggcgcccaggtggaggacgaggccgactactactgctacagcaccgacaacgacggcaagtacttcgtgttcggcagcggcaccatggtgaccgtgctg

SEQ ID NO: 31956 - RNA, 318 nt, synthetic construct
  misc_feature 1..318: note = derived and/or modified sequence opt4 from anti-HIV_V3_LightChain
  source 1..318: mol_type = other RNA
agctacgagctgacccagccccccagcgtgagcgtgagccccggccagaccgccagcatcacctgcagcggccacaagctgggcgacaagtacgccagctggtaccagcacaagcccggccagagccccgtgctggtgatctacgaggacacccagagacccagcggcatccccgagagaatcagcggcagcaagagcggcaacaccgccaccctgaccatcagcggcacccaggccatggacgaggccgactactactgccaggcctgggacagcagagccgccgtgttcggcggcggcaccagactgaccgtgctg

SEQ ID NO: 31957 - RNA, 327 nt, synthetic construct
  misc_feature 1..327: note = derived and/or modified sequence opt4 from anti-HIV_V3_LightChain
  source 1..327: mol_type = other RNA
cagagcgccctgacccagcccgccagcgtgagcggcagccccggccagagcatcaccatcagctgcaccggcatcagcagcgacatcggcaccgacaactacgtgagctggtaccagcagcaccccggcaaggcccccaagctgatcatctacgaggtgagcaacagacccagcggcatcagccacagattcagcggcagcaagagcggcaacaccgccagcctgatcatcagcggcctgcaggtggaggacgaggcccactactactgcaacagctacagaagcgacaccctggtgttcggcggcggcaccaaggtgaccgtgctg

SEQ ID NO: 31958 - RNA, 333 nt, synthetic construct
  misc_feature 1..333: note = derived and/or modified sequence opt4 from anti-HIV_V3_LightChain
  source 1..333: mol_type = other RNA
cagagcgtgctgacccagccccccagcgccagcggcacccccggccagagagtgaccatcagctgcagcggcagcagcagcaacatcggcagcaacaccgtgaactggtaccagcacctgcccggcaccgcccccaagctgctgatctacagcaacgaccagagacccagcggcgtgcccgacagattcagcggcagcagcagcggcaccagcgccagcctggccatcagcggcctgcagagcgaggacgaggccgactactactgcgccgcctgggacgacagcctgaacggccccttcgtgttcggcaccggcaccaaggtgaccgtgctg

SEQ ID NO: 31959 - RNA, 318 nt, synthetic construct
  misc_feature 1..318: note = derived and/or modified sequence opt4 from anti-HIV_V3_LightChain
  source 1..318: mol_type = other RNA
gacatccagatgacccagagccccagcagcctgagcgccagcgtgggcgacagaatcaccatcacctgcagaaccagccagagcatcgacaaccacctgaactggtaccagcacaagcccggcaaggcccccaagctgctgatcagcgccgccagcagactgcagagcggcgtgcccagcagattcaccggcagcggcagcggcaccgagttcaccctgaccatcagcagcctgcagcccgaggacttcgccgtgtactactgccagcagagctacatcaccatcaccttcggccccggcaccaaggtggacatcaag

SEQ ID NO: 31960 - RNA, 321 nt, synthetic construct
  misc_feature 1..321: note = derived and/or modified sequence opt4 from anti-HIV_V3_LightChain
  source 1..321: mol_type = other RNA
gagatcgtgatgacccagagccccgccaccctgagcgtgagccccggcgagggcgtgaccctgagctgcagagccagccagagcgtgagcagcaacatcctgtggtaccagcagagacccggccaggcccccagactgctgctgtacggcgccagcaccagagccaccggcatccccgccagattcagcggcagcggcagcggcaccgagttcaccctgaccatcaacagcatgcagagcgaggacttcgccatctactactgccagcagtaccacgactggctgtggaccctgggccagggcacccaggtggagatcaag

SEQ ID NO: 31961 - RNA, 327 nt, synthetic construct
  misc_feature 1..327: note = derived and/or modified sequence opt4 from anti-HIV_V3_LightChain
  source 1..327: mol_type = other RNA
agctacgagctgacccagccccccagcgtgagcgtgagccccggccagaccgccagcatcacctgcagcggcgacaagatgggcgagagatacaccagctggtaccagcagaagcccggccagagccccgtgctggtgatgagcgagaacatcaagagacccgccggcatccccgagagattcagcggcagcagcagcggcaacaccgccatcctgaccatcagcggcacccaggccgtggacgaggccgactactactgccaggtgtgggacaccaccaccaccagctacgtgatcttcggcggcggcaccaagctgaccgtgctg

SEQ ID NO: 31962 - RNA, 321 nt, synthetic construct
  misc_feature 1..321: note = derived and/or modified sequence opt4 from anti-HIV_V3_LightChain
  source 1..321: mol_type = other RNA
gacatccagatgacccagagccccagcagcctgagcgccagcgtgggcgacagagtgaccatcacctgccaggccagccaggacatcggcaactacctgaactggtaccaccagaagcccggcaaggcccccaagctgctgatctacgacgccagcaacgtggagaccggcgtggccagcagattcagcggcagcggcagcggcaccgacttcaccctgaccatcagcagcctgcagcccgaggacatcggcacctacttctgccagcagtacgagagcctgccctgggccttcggcggcggcaccaaggtggagatcaga

SEQ ID NO: 31963 - RNA, 333 nt, synthetic construct
  misc_feature 1..333: note = derived and/or modified sequence opt4 from anti-HIV_V3_LightChain
  source 1..333: mol_type = other RNA
aacttcaagctgacccagccccacagcgtgagcgagagccccggcaagaccgtgaccatcagctgcaccagaaccagcggcaccatcgccaccaactacgtgcagtggttccagcagagacccggcagcagccccaccaccatgatctacgagaacgacaagagacccagcggcgtgcccgacagattcagcggcagcatcgacaccagcagcaacagcgccagcctgaccatcagcggcctgaagaccgaggacgaggccgactactactgccagagctacaacagcaccgacatcgtggtgttcggcggcggcaccaagctgaccgtgctg

SEQ ID NO: 31964 - RNA, 327 nt, synthetic construct
  misc_feature 1..327: note = derived and/or modified sequence opt4 from anti-HIV_V3_LightChain
  source 1..327: mol_type = other RNA
cagagcgtgctgacccagccccccagcgtgagcgccgcccccggccagaaggtgaccatcagctgcagcggcagcagcagcaacatcggcaacaacatggtgagctggtaccagcagcaccccggcaccgcccccaagctgctgatctacgagaacagcaagagacccagcggcatccccgacagattcagcggcagcagaagcggcaccagcgccaccctgggcatcatcggcctgcagaccggcgacgaggccgagtactactgcgccacctgggacggcagcctgagaaccgtgttcggcggcggcaccaagctgaccgtgctg

SEQ ID NO: 31965 - RNA, 324 nt, synthetic construct
  misc_feature 1..324: note = derived and/or modified sequence opt4 from anti-HIV_V3_LightChain
  source 1..324: mol_type = other RNA
agctacgagctgacccagccccccagcgtgagcgtgagccccggccagaccgccagaatcacctgcagcggcgacgccctgcccaaccagtacggctactggtaccagcagaagcccggccaggcccccgtgctggtgatcttcaaggacagcgagagacccagcggcatccccgagagattcagcggcagcagcagcggcaccaccgtgaccctgaccatcagcggcgtgcaggccgaggacgaggccgactactactgccagagcgccgacagcagcggcaactacgaggtgttcggcggcggcaccaagctgaccgtgctg

SEQ ID NO: 31966 - RNA, 330 nt, synthetic construct
  misc_feature 1..330: note = derived and/or modified sequence opt4 from anti-HIV_V3_LightChain
  source 1..330: mol_type = other RNA
cagagcgtgctgacccagccccccagcgtgagcgaggcccccagacagagagtgaccatcagctgcagcggcagcagcagcaacatcggcaacaacgccgtgaactggtaccagcaggtgcccggcaaggcccccaagctgctgatctactacgacgacctgctgcccagcggcgtgagcgacagattcagcggcagcaagagcggcagcagcgccagcctggccatcagcggcctgcagagcgaggacgaggccgactactactgcgccgcctgggacgacagcctgaaggtgtacgtgttcggcaccggcaccagcgtgaccgtgctg

SEQ ID NO: 31967 - RNA, 333 nt, synthetic construct
  misc_feature 1..333: note = derived and/or modified sequence opt4 from anti-HIV_V3_LightChain
  source 1..333: mol_type = other RNA
gacatcgtgatgaaccagagcccccccagcctggccgtgacccccggcgagcccgccagcatcagctgcagagccagccagagcctgctgtacagcgacggccacaactacctggactggtacctgcagaagcccggccaggccccccagctgctgatctacctgggcagcaccagagccagcggcgtgcccgacagattcagcggcagcggcagcggcaccgacttcaccctgaagatcagcagagtggaggccgaggacgtgggcgtgtactactgcatgcagcccctgcagagctacaccttcggccagggcaccaagctggagatcaag

SEQ ID NO: 31968 - RNA, 321 nt, synthetic construct
  misc_feature 1..321: note = derived and/or modified sequence opt4 from anti-HIV_V3_LightChain
  source 1..321: mol_type = other RNA
gcctacgagctgacccagccccccagcgtgagcgtgagccccggccagaccgccagaatcacctgcagcggcgacgccctgcccaaccagtacgcctactggtaccaccagagacccggccaggcccccgtgctggtgatccacaaggacaccgagagacccagcggcatccccgccagattcagcggcagcagcagcggcaccaccgtgaccctgaccatcagcgaggtgcaggccgaggacgagggcgactactactgccagagcgccgacaccagcgcctacgtggtgttcggcggcggcaccaagctgaccgtgctg

SEQ ID NO: 31969 - RNA, 330 nt, synthetic construct
  misc_feature 1..330: note = derived and/or modified sequence opt4 from anti-HIV_V3_LightChain
  source 1..330: mol_type = other RNA
cagagcgtgctgacccaggcccccagcagcagcggcacccccggccagagcgtgaccatcagctgcagcggcagcagcagcaacatggagatcaactacgtgtactggtacagacagttccccggcaccgccccccagctgctgatctacaacgacaaccagagacccagcggcgtgcccgacagattcagcgccagcaagagcggcaccagcgccagcctggccatcggcggcctgagaagcgaggacgaggccgactacttctgcgccgtgtggcacggcgacagaggcggccccgtgttcggcggcggcaccaagctgaccgtgctg

SEQ ID NO: 31970 - RNA, 327 nt, synthetic construct
  misc_feature 1..327: note = derived and/or modified sequence opt4 from anti-HIV_V3_LightChain
  source 1..327: mol_type = other RNA
agctacgagctgaagcagcccagaagcgtgagcgtgagccccggccagaccgccagaatcacctgcagcggcgacgccatgcccaaccagtacgcctactggtaccagcagagacccggcagagcccccgtgctgctgatcttcaaggacaacgagagagccagcggcatccccgagagaatcagcggcagcagcagcggcaccaccgccaccctgaccatcaacagagtgcaggccgaggacgaggccgactacctgtgccagagcgccgacagcagcggcgccttcccctgggtgttcggcggcggcaccaccctgaccgtgctg

SEQ ID NO: 31971 - RNA, 324 nt, synthetic construct
  misc_feature 1..324: note = derived and/or modified sequence opt4 from anti-HIV_V3_LightChain
  source 1..324: mol_type = other RNA
agctacgagctgacccagccccccagcgtgagcgtgagccccggccagaccgccagaatcacctgcagcggcgacgccctgcccaaggagtacgcctactggtaccagcagaagagcggccaggcccccgtgctggtgatctacgaggacaccagaagacccagcggcatccccgagagattcagcggcagcagcagcggcaccatggccaccctgaccgtgagcggcgcccacgtggacgacgaggccgactactactgctacagcagagacaccagcgccaaccagtgggtgttcggcggcggcaccaagctgaccgtgctg

SEQ ID NO: 31972 - RNA, 318 nt, synthetic construct
  misc_feature 1..318: note = derived and/or modified sequence opt4 from anti-HIV_V3_LightChain
  source 1..318: mol_type = other RNA
gagatcgtgctgacccagagccccgccaccctgagcctgagccccggcgagagagccaccctgagctgcagagccagccagagcatcagcacctacctgggctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagatacacctggatcaccttcggccagggcaccagactggagatcaag

SEQ ID NO: 31973 - RNA, 327 nt, synthetic construct
  misc_feature 1..327: note = derived and/or modified sequence opt4 from anti-HIV_V3_LightChain
  source 1..327: mol_type = other RNA
agctacgagctgacccagccccccagcgtgagcgtgagccccggccagaccgccagaatcacctgcagcggcgacgccctgcccaaccagtacgtgtactggtaccagcagagacccggccaggcccccgtggtggtgctgtacaaggacaccgagagacccagcggcatccccgagagattcagcggcagcagcagcggcaccaccgtgaccctgaccatcagcggcgtgcaggccgaggacgaggccgactactactgccagagcgccgacaacagcggcgcctaccccctgttcttcggcggcggcaccaagctgaccgtgctg

SEQ ID NO: 31974 - RNA, 333 nt, synthetic construct
  misc_feature 1..333: note = derived and/or modified sequence opt4 from anti-HIV_V3_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgctgtggtaccagcagttccccggcaccgcccccaagctgctgatctacggcaacaacaagagacccagcggcatccccgacagattcagcggcagcaagagcggcaccagcgccaccctgggcatcaccggcctgcagaccggcgacgaggccgactacttctgcgccacctgggacagcggcctgagcgccgactgggtgttcggcggcggcaccaagctgaccgtgctg

SEQ ID NO: 31975 - RNA, 321 nt, synthetic construct
  misc_feature 1..321: note = derived and/or modified sequence opt4 from anti-HIV_V3_LightChain
  source 1..321: mol_type = other RNA
gacatccagatgacccagagccccagcagcctgagcgccagcgtgggcgacagagtgaccatcacctgcagagccagccaggagatcgacaactacctggcctggtaccagcagagacccggcaaggcccccaagagcctgatctacgccgccagcagcctgcagggcggcgtgccccccaagttcagcggcagcggcagcggcaccgagttcaccctgaccatcagcagcctgcaggccgaggacttcgccacctactactgccagcagtacaacgcctaccccctgaccttcggccagggcaccagactggacatcaac

SEQ ID NO: 31976 - RNA, 324 nt, synthetic construct
  misc_feature 1..324: note = derived and/or modified sequence opt4 from anti-HIV_V3_LightChain
  source 1..324: mol_type = other RNA
agctacgagctgacccagccccccagcctgagcgtgagccccggccagaccgccagcatcacctgcagcggcgacggcctgcccaagcagtacggctactggtaccagcagaagcccggccaggcccccctgctggtgatcctgaaggacaccgagagacccagcggcatccccgagagattcagcggcagcagcagcggcaccaccgtgaccctgaccatcagcggcgtgcaggccgaggacgaggccgactactactgccagagcgtggacagcaccggcagctactacgtgttcggccccggcaccaaggtgaccgtgctg

SEQ ID NO: 31977 - RNA, 324 nt, synthetic construct
  misc_feature 1..324: note = derived and/or modified sequence opt4 from anti-HIV_V3_LightChain
  source 1..324: mol_type = other RNA
agctacgagctgacccagccccccagcgtgagcgtgagccccggccagaccgccagaatcacctgcagcggcgacgtgctgcccaagaagtacgcctactggtaccagcagaagagcggcctggcccccgtgctggtgatctacgaggacaacagaagacccagcggcatccccgagagattcagcggcagcagcagcggcaccatggccaccctgaccatcagcggcgcccaggtggaggacgagggcgactactactgcagcagcaccgacagcagcggcgaccactacgtgttcggcaccggcaccaaggtgaccgtgctg

SEQ ID NO: 31978 - RNA, 321 nt, synthetic construct
  misc_feature 1..321: note = derived and/or modified sequence opt4 from anti-HIV_V3_LightChain
  source 1..321: mol_type = other RNA
gcctacgagctgacccagccccccagcgtgagcgtgagccccggccagaccgccagaatcacctgcagcgccgaggccctgagcaaccagtacgcctactggtacagacagagacccggccaggcccccctgctgatcatctacaaggacaccaagagacccagcggcatccccgagagattcagcggcagcaccagcggcaccaccgtgaccctgaccatcagcggcgtgcaggccgaggacgaggccgactactactgccagagcgccgacagcagcggcgactacgtgttcggcggcggcaccaaggtgaccgtgctg

SEQ ID NO: 31979 - RNA, 333 nt, synthetic construct
  misc_feature 1..333: note = derived and/or modified sequence opt4 from anti-HIV_CD4bs_LightChain
  source 1..333: mol_type = other RNA
cagcccgtgctgacccagagcagcagcgccagcgccagcctgggcagcagcgtgaagctgacctgcaccctgggcagcggccacagcggcagcatcatcgcctggcaccagcagcagcccggcaaggcccccagatacctgatgaaggtgcagagcagcggcagctacaacaagggcagcggcgtgcccgacagattcagcggcagcagcagcggcgccgacagatacctgaccatcagcaacctgcagttcgaggacgagggcgactactactgcgagacctgggacaccaacaagtacgtgttcggcaccggcaccaaggtgaccgtgctg

SEQ ID NO: 31980 - RNA, 324 nt, synthetic construct
  misc_feature 1..324: note = derived and/or modified sequence opt4 from anti-HIV_CD4bs_LightChain
  source 1..324: mol_type = other RNA
gagctggtgctgacccagagccccggcaccctgagcctgagccccggcgagagagccaccctgagctgcagagccagccagagcgtggccagctactacctggcctggtaccagcagaagcccggccaggcccccagactgctgatctacggcgccagcagcagagccaccggcatccccgacagattcagcggcagcgtgagcggcaccgacttcaccctgaccatcagcagactggagcccgaggacttcgccctgtactactgccagcagtacggcagcagccccctgagcttcggcggcggcaccaaggtggagatcaga

SEQ ID NO: 31981 - RNA, 333 nt, synthetic construct
  misc_feature 1..333: note = derived and/or modified sequence opt4 from anti-HIV_CD4bs_LightChain
  source 1..333: mol_type = other RNA
cagagcgccctgacccagccccccagcatgagcggcagccccggccagagcatcaccatcagctgcaccggcagcggcagcgacgtgggcagccacaacttcgtgagctggtaccagcagcaccccgccagagtgcccaagctgctgatctacgccgtgggcaacagacccagcggcgtgagcgagagattcagcggcagcaagagcggcaacaccgcctacctgaccatcagcggcctgcaggccgacgacgaggccgactactactgcagcagccacaccaccggcaccaccctggaggtgttcggcggcggcaccagactgaccgtgctg

SEQ ID NO: 31982 - RNA, 333 nt, synthetic construct
  misc_feature 1..333: note = derived and/or modified sequence opt4 from anti-HIV_CD4bs_LightChain
  source 1..333: mol_type = other RNA
gacatcgtgatgacccagagccccctgagcctgcccgtgacccccggcgagcccgccagcatcagctgcagaagcagcgagagcctgctgcacagcaacggcttcatctacctggactggtacctgcagaagcccggccagagcccccagctgctgatctacctgggcagcaagagagccagcggcgtgagcgacagattcagcggcagcggcagcggcaccgccttcaccctgaagatcagcagagtggaggccgaggacgtgggcgtgtactactgcatgcaggccctggagagcagaaccttcggccagggcaccaagctggagatcaag

SEQ ID NO: 31983 - RNA, 327 nt, synthetic construct
  misc_feature 1..327: note = derived and/or modified sequence opt4 from anti-HIV_CD4bs_LightChain
  source 1..327: mol_type = other RNA
gagatcgtgctgacccagagccccggcaccctgagcctgagccccggcgagagagccaccctgagctgcagagccagccagagcgtgagcagcagctacctggcctggtaccagcagaagcccggccagagccccagactgctgatctacggcgccagcagcagagccaccggcatccccgacagattcagcggcagcggcagcggcaccgacttcaccctgaccatcagcagactggagcccgaggacttcgccgtgtactactgccagcactacggcagcagcagcatcttcaccttcggccccggcaccaaggtggacatcaga

SEQ ID NO: 31984 - RNA, 330 nt, synthetic construct
  misc_feature 1..330: note = derived and/or modified sequence opt4 from anti-HIV_CD4bs_LightChain
  source 1..330: mol_type = other RNA
aacttcatgctgacccagccccacagcgtgagcggcagccccggcaagaccgtgaccatcagctgcaccagaagcagcggcagcatcgccggcaactacgtgcagtggtaccagcagagacccggcaccagccccaccaccgtgatctacgagaacgaccagagaagcagcggcgtgcccgacagattcagcggcagcatcgacagcagcagcaacagcgccagcctgaccatcagcggcctgaagaccgaggacgaggccgactactactgccacagctacgacgccaccaaccaggtgttcggcggcggcaccaagctgaccgtgctg

SEQ ID NO: 31985 - RNA, 333 nt, synthetic construct
  misc_feature 1..333: note = derived and/or modified sequence opt4 from anti-HIV_CD4bs_LightChain
  source 1..333: mol_type = other RNA
gacgtggtggtgacccagagccccctgagcctgcccgtgaccctgggccagcccgccagcatcagctgcagaagcagccagagcctggtgtacagcgacggcaccacccacctgaactggtaccaccagagacccggccagccccccagaagactgatctacagagtgagcaacagagacagcggcgtgcccgacagattcagcggcagcggcagcggcaccgacttcaccctgagaatcagcagagtggaggccgaggacgtgggcctgtactactgcatgctggccacccaccccttcaccttcggccccggcaccaaggtggagatcaag

SEQ ID NO: 31986 - RNA, 336 nt, synthetic construct
  misc_feature 1..336: note = derived and/or modified sequence opt4 from anti-HIV_CD4bs_LightChain
  source 1..336: mol_type = other RNA
cagagcgtgctgacccagccccccagcgtgagcggcgcccccggccagaccgtgaccatcagctgcaccggcagcagcagcaacatcggccccagctacgacgtgcagtggtaccagcagttccccggcagagcccccaagctgctgatcagcggcaacaacaacagagccagcggcgtgcccgacagattcagcggcagcaagagcggcaccagcgccagcctggccatcaccggcctgcagagcgaggacgaggccgactactactgccagacctacgacagcagcctgagcggccacgtggtgttcggcggcggcaccagactgaccgtgctg

SEQ ID NO: 31987 - RNA, 321 nt, synthetic construct
  misc_feature 1..321: note = derived and/or modified sequence opt4 from anti-HIV_CD4bs_LightChain
  source 1..321: mol_type = other RNA
gacatccagatgacccagagccccagcaccctgagcgccagcgtgggcgacagagtgaccatcacctgcagagccagcgccagcatctacacctggctggcctggtaccagcagagacccggcaaggcccccgaggtgctgatctacaaggccagcaccctgaagagcggcgtgcccagcagattcagcggcagcggcagcggcaccgagttcaccctgaccatcagcagcctgcagcccggcgacttcgccacctactactgccagcagtacaccacctaccccctgaccttcggcggcggcaccaccgtggagatcaag

SEQ ID NO: 31988 - RNA, 330 nt, synthetic construct
  misc_feature 1..330: note = derived and/or modified sequence opt4 from anti-HIV_CD4bs_LightChain
  source 1..330: mol_type = other RNA
cagagcgccctgacccagcccgccagcgtgagcggcagccccggccagagcatcaccatcagctgcaccggcaccagcaacgacatcggcacctacaacctggtgagctggtaccagcaccaccccaacaaggcccccaaggtggtggtgtacgagaacaacaagagacccagcggcatcagcaacagattcagcggcagcaagagcggcaacaccgccagcctgaccatcagcggcctgcaggccgaggacgaggccgactactactgctgcagctacgccggcagcagcacctgggtgttcggcggcggcaccaagctgaccgtgctg

SEQ ID NO: 31989 - RNA, 321 nt, synthetic construct
  misc_feature 1..321: note = derived and/or modified sequence opt4 from anti-HIV_V2_LightChain
  source 1..321: mol_type = other RNA
gacatccagatgacccagagccccagcaccctgagcgccagcgtgggcgacagagtgaccatcacctgcagagccagccagaccatcagcagctggctggcctggtaccagcagaagagcggcaccgcccccaagctgctgatctacaaggccagcagcatcgtgagcggcgtgcccagcagattcagcggcagcggcagcggcaccgagttcaccctgaccatcaccagcctgcagcccgacgacttcgccacctactactgccagcagtacaacagcagccccgagaccttcggccagggcaccaaggtggagatcaag

SEQ ID NO: 31990 - RNA, 318 nt, synthetic construct
  misc_feature 1..318: note = derived and/or modified sequence opt4 from anti-HIV_V2_LightChain
  source 1..318: mol_type = other RNA
gagatcgtgctgacccagagccccggcaccctgagcctgagccccggcgagagagccaccctgagctgcagagccagccagagcgtgagcagctacctggcctggtaccagcagaagcccggccaggcccccagactgctgatctacgacgccagcagcagagccaccggcatccccgacagattcagcggcagcggcagcggcaccgacttcaccctgaccatcagcagactggagcccgaggacttcgccgtgtactactgccagcactacgccggcagcagaaccttcggccagggcaccaaggtggagatcaag

SEQ ID NO: 31991 - RNA, 333 nt, synthetic construct
  misc_feature 1..333: note = derived and/or modified sequence opt4 from anti-HIV_V2_LightChain
  source 1..333: mol_type = other RNA
cagagcgtgctgacccagccccccagcgtgagcggcgcccccggccagagagtgaccatcagctgcaccggcagcagcagcaacatcggcgcccactacgacgtgcactggtaccagcagctgcccggcaccgcccccaagctgctgatctacggcaacagcaacagacccagcggcgtgcccgacagattcagcggcagcaagagcggcaccagcgccagcctggccatcaccggcctgcaggccgaggacgaggccgactactactgccagagctacgacagcagcctgagcggctacgtgttcggcaccggcaccaaggtgaccgtgctg

SEQ ID NO: 31992 - RNA, 324 nt, synthetic construct
  misc_feature 1..324: note = derived and/or modified sequence opt4 from anti-HIV_V2_LightChain
  source 1..324: mol_type = other RNA
gacaccgtgatgacccagagccccgccaccctgagcgtgagccccggcgagagagtgaccctgagctgcagagccagccagatcatcaacaccaacctggcctggtaccagaagagacccggccaggcccccagactgctgatctacgccgccagcgccagagccaccggcatccccgccagattcagcggcagcggcagcggcaccgagttcaccctgaccatcagcggcctgcagagcgaggacagcgccgtgtactactgccagcagtacaagcactggcccccctacaccttcggcagaggcaccaagctggagatcaga

SEQ ID NO: 31993 - RNA, 321 nt, synthetic construct
  misc_feature 1..321: note = derived and/or modified sequence opt4 from anti-HIV_V2_LightChain
  source 1..321: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcagaaccttcggccagggcaccaaggtggagatcaag

SEQ ID NO: 31994 - RNA, 321 nt, synthetic construct
  misc_feature 1..321: note = derived and/or modified sequence opt4 from anti-HIV_V2_LightChain
  source 1..321: mol_type = other RNA
gacatccagatgacccagagccccagcagcctgagcgccagcgtgggcgacagagtgaccatcacctgcagagccagccagagcatcagcggcaacctgaactggtaccagcagaagcccggcaaggcccccaacctgctgatctacggcgccagcagcctgcagagcggcgtgcccagcagattcagcggcagcggcagcggcaccgacttcaccctgaccatcagcagcctgcagcccgaggacttcgccacctaccactgccagcagagccacagcaccagctggaccttcggccagggcaccaaggtggtgatcaag

SEQ ID NO: 31995 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaaccactacaccagctggtaccagcagaagaccggccaggcccccgtgctgctgatctaccccaagcacaacagaagccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccgaggtgaccggcctg

SEQ ID NO: 31996 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaaccactacaccagctggtaccagcagaagaccggccaggcccccgtgctgctgatctaccccaagcacaacagaagccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccaaggtgaccgtggtg

SEQ ID NO: 31997 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaactactacaccagctggtaccagcagaagcccggccaggcccccgtgctgctgatctaccccaagcacaacagaccccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccaaggtgaccggcctg

SEQ ID NO: 31998 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaactactacaccagctggtaccagcagaagcccggccaggcccccgtgctgctgatctaccccaagcacaacagaccccccggcatcagcgacagattcagcgccagcagcagcggcaacaccgccagcctgaccatcaccggcgcccagaccgaggacgagggcgactactactgcagcagcagagacaagagcggcagcagactggtgaccttcggcagaggcaccaagctgaccgtggtg

SEQ ID NO: 31999 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaaccactacaccagctggtaccagcagaagaccggccaggcccccgtgctgctgatctaccccaagcacaacagaagccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccaaggtgaccgtgctg

SEQ ID NO: 32000 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaactactacaccagctggtaccagcagaagcccagacaggcccccgtgctgctgatctaccccaagcacaacagaccccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccaagctgaccgtgctg

SEQ ID NO: 32001 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaactactacaccagctggtaccagcagaagcccggccaggcccccgtgctgctgatctaccccaagcacaacagaccccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccaagctgaccgtgctg

SEQ ID NO: 32002 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccaccgtgagcgtggccctgggccagaccgtgaccatcacctgcagaggcgacagcctgagaaaccactacaccagctggtaccagcagaagaccggccaggcccccatcctgctgatctaccccaagcacaacagaccccccggcatcagcgacagattcagcgccagcagcagcggcaacaccgccagcctgaccatcaccggcgcccagaccgaggacgagggcgactactactgcagcagcagagacaagagcggcagcagactggtgaccttcggcggcggcaccaagctgaccgtgctg

SEQ ID NO: 32003 - RNA, 327 nt, synthetic construct
  misc_feature 1..327: note = derived and/or modified sequence opt4 from anti-HIV_10E8
  source 1..327: mol_type = other RNA
agcagcgacctgacccaggaccccgccgtgagcgtggccctgggccagaccgtgagaatcacctgccagggcgacagcctgagaagatactacgccggctggtaccagcagaagcccggccaggcccccgtgctggtggtgtacggcagagacaacagacccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32004 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccgccgtgagcgtggccttcgagaagaccgtgaccatcacctgccagggcgacagcctgagaagccactacgtgagctggtaccagaagagacccggccaggcccccgtgctggtgttctacggcaagaacaacagacccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgccc

SEQ ID NO: 32005 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccgccgtgagcgtggccctgaagcagaccgtgaccatcacctgcagaggcgacagcctgagaagccactacgtgagctggtaccagcagaagcccggccaggcccccgtgctggtgttctacggcaagaacaacagacccagcggcatccccgacagattcagcggcagcagcagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32006 - RNA, 327 nt, synthetic construct
  misc_feature 1..327: note = derived and/or modified sequence opt4 from anti-HIV_10E8
  source 1..327: mol_type = other RNA
agcagcgagctgacccaggaccccggcgtgagcgtggccctgaagcagaccgtgaccatcacctgcagaggcgacagcctgagaagccactacgtgagctggtaccagaagaagcccggccaggcccccgtgctggtgttctacggcaagaacatcggccccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32007 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccgccgtgagcgtggccctgaagcagaccgtgaccatcacctgcagaggcgacagcctgagaagccactacgtgagctggtaccagaagaagcccggccaggcccccgtgctggtgttctacggcaagaacaacagacccagcggcatccccgacagattcagcggcagcagcagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32008 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccggcgtgagcgtggccctgaagcagaccgtgaccatcacctgcagaggcgacagcctgagaagccactacgtgagctggtaccagaagagacccggccaggcccccgtgctggtgttctacggcaagaacaacagacccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32009 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccggcgtgagcgtggccctggagcagaccgtgaccatcacctgcagaggcgacagcctgagaagccactacgtgagctggtaccagaagaagcccggccaggcccccgtgctggtgttctacggcaagaacaacagacccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32010 - RNA, 327 nt, synthetic construct
  misc_feature 1..327: note = derived and/or modified sequence opt4 from anti-HIV_10E8
  source 1..327: mol_type = other RNA
gccagcgagctgacccaggaccccggcgtgagcgtggccctgaagcagaccgtgaccatcacctgcagaggcgacagcctgagaagccactacgtgagctggtaccagaagaagcccggccaggcccccgtgctggtgttctacggcaagaacaacagacccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32011 - RNA, 327 nt, synthetic construct
  misc_feature 1..327: note = derived and/or modified sequence opt4 from anti-HIV_10E8
  source 1..327: mol_type = other RNA
agcagcgagctgacccaggaccccggcgtgagcgtggccctgaagcagaccgtgaccatcacctgcagaggcgacagcctgagaagccactacgtgagctggtaccagaagaagcccggccaggcccccgtgctggtgttctacggcaagaacaacagacccagcggcatccccgacagattcagcggcagcaccagcggcaacaccgccagcctgaccatcgccggcgcccaggccgaggacgacgccgactactactgcagcagcagagacaagagcggcagcagactgagcgtgttcggcggcggcaccaagctgaccgtgctg

SEQ ID NO: 32012 - RNA, 327 nt, synthetic construct
  misc_feature 1..327: note = derived and/or modified sequence opt4 from anti-HIV_10E8
  source 1..327: mol_type = other RNA
agcagcgagctgacccaggagaccggcgtgagcgtggccctgggcagaaccgtgaccatcacctgcagaggcgacagcctgagaagccactacgccagctggtaccaggagaagcccggccaggcccccaagctgctgttctacggcaagaacaacagacccagcggcatccccgacagattcagcggcagcgccagcggcaacagagccagcctgaccatcagcggcgcccaggccgaggacgacgccgagtactactgcagcagcagagacaagagcggcagcagactgagcgtgttcggcggcggcaccaagctggccgtgctg

SEQ ID NO: 32013 - RNA, 327 nt, synthetic construct
  misc_feature 1..327: note = derived and/or modified sequence opt4 from anti-HIV_10E8
  source 1..327: mol_type = other RNA
agcagcgagctgacccaggagaccggcgtgagcgtggccctgggcagaaccgtgaccatcacctgcagaggcgacagcctgagaagccactacgccagctggtaccagaagaagcccggccaggcccccaagctgctgttctacggcaagaacaacagacccagcggcatccccgacagattcagcggcttcgccagcggcaacagagccagcctgaccatcagcggcgcccaggccgaggacgacgccgagtactactgcagcagcagagacaagagcggcagcagactgagcgtgttcggcggcggcaccaagctgaccgtgctg

SEQ ID NO: 32014 - RNA, 327 nt, synthetic construct
  misc_feature 1..327: note = derived and/or modified sequence opt4 from anti-HIV_10E8
  source 1..327: mol_type = other RNA
agcagcgagctgacccaggagaccggcgtgagcgtggccctgggcagaaccgtgaccatcacctgcagaggcgacagcctgagaagccactacgccagctggtaccagaagaagcccggccaggcccccaagctgctgttctacggcaagaacaacagacccagcggcatccccgacagattcagcggcagcgccagcggcaacagagccagcctgaccatcagcggcgcccaggccgaggacgacgccgagtacatctgcagcagcagagacaagagcggcagcagactgagcgtgttcggcggcggcaccaagctgaccgtgctg

SEQ ID NO: 32015 - RNA, 327 nt, synthetic construct
  misc_feature 1..327: note = derived and/or modified sequence opt4 from anti-HIV_10E8
  source 1..327: mol_type = other RNA
agcagcgagctgacccaggagaccggcgtgagcgtggccctgggcagaaccgtgaccatcacctgcagaggcgacagcctgagaagccactacgccagctggtaccagaagaagcccggccaggcccccaagctgctgttctacggcaagaacaacagacccagcggcatccccgacagattcagcggcagcgccagcggcaacagagccagcctgaccatcagcggcgcccaggccgaggacgacgccgagtactactgcagcagcagagacaagagcggcagcagactgagcgtgttcggcggcggcaccaagctgaccgtgctg

SEQ ID NO: 32016 - RNA, 327 nt, synthetic construct
  misc_feature 1..327: note = derived and/or modified sequence opt4 from anti-HIV_10E8
  source 1..327: mol_type = other RNA
agcagcgagctgacccaggagaccggcgtgagcgtggccctgggcagaaccgtgaccatcacctgcagaggcgacagcctgagaagccactacgccagctggtaccagaagaagcccggccaggcccccatcctgctgttctacggcaagaacaacagacccagcggcatccacgacagattcagcggcagcgccagcggcaacagagccagcctgaccatcagcggcgcccaggccgaggacgacgccgagtactactgcagcagcagagacaagagcggcagcagactgagcgtgttcggcggcggcaccaagctgaccgtgctg

SEQ ID NO: 32017 - RNA, 393 nt, synthetic construct
  misc_feature 1..393: note = derived and/or modified sequence opt4 from anti-HIV_10E8
  source 1..393: mol_type = other RNA
gaggtgcagctggtggagagcggcggcgacctggtgaagcccggcggcagcctgagactgagctgcagcgccagcggcttcagcttcaagaacacctggatgacctgggtgagacaggcccccggcaagggcctggagtgggtgggcagaatcaccggccccggcgagggctggaccagcgactacgccgccaccgtgcagggcagattcaccatcagcagaaacaacatgatcgacatgctgtacctggagatgaacagactgagaaccgacgacaccggcctgtactactgcgtgcacaccgagaagtactacaacttctggggcggctacccccccggcgaggagtacttccagcactggggcagaggcaccctggtgatcgtgagcagc

SEQ ID NO: 32018 - RNA, 393 nt, synthetic construct
  misc_feature 1..393: note = derived and/or modified sequence opt4 from anti-HIV_10E8
  source 1..393: mol_type = other RNA
gagatcagactggtggagagcggcggcggcctggtgaagcccggcggcagcctgagactgagctgcagcgccagcggcttcaacttcgacagcgcctggatgacctgggtgagacagccccccggcaagggcctggagtgggtgggcagaatcaccggccccggcgagggctggagcgtgggctacgccgagagcgtgaagggcagattcatcatcagcagaatcaacagcatcaacttcctgtacctggagatgaacaacctgagacccgaggacaccggcagctacttctgcgcccacaccggcaagcactacgacttctggagaggctacccccccggcgaggagtacttccaggactggggccagggcacccaggtgatcgtgagcagc

SEQ ID NO: 32019 - RNA, 393 nt, synthetic construct
  misc_feature 1..393: note = derived and/or modified sequence opt4 from anti-HIV_10E8
  source 1..393: mol_type = other RNA
gagatcagactggtggagagcggcggcggcctggtgaagcccggcggcagcctgagactgagctgcagcgccagcggcttcaacttcgacagcgcctggatgacctgggtgagacagccccccggcaagggcctggagtgggtgggcagaatcaccggccccggcgagggctggagcgtggactacgccgagagcgtgaagggcagattcatcatcagcagaatcaacagcatcaacttcctgtacctggagatgaacaacctgagacccgaggacaccggcagctacttctgcgcccacaccggcaagcactacgacttctggagaggctacccccccggcgaggagtacttccaggactggggccagggcacccaggtgatcgtgagcagc

SEQ ID NO: 32020 - RNA, 393 nt, synthetic construct
  misc_feature 1..393: note = derived and/or modified sequence opt4 from anti-HIV_10E8
  source 1..393: mol_type = other RNA
gaggtgagactggtggagagcggcggcagactggtgagacccggcggcagcctgagactgagctgcagcgccagcggcttcaacttcgacaacgcctggatgacctgggtgagacagccccccggcaagggcctggagtgggtgggcagaatcaccggccccggcgagggctggagcgtggactacgccgccagcgtgaagggcagattcaccatcagcagaatgaacagcatcaacttcttctacctggagatgaacaacctgaagatcgaggacaccggcctgtacttctgcgccagaaccggcaagcactacgccttctggggcggctacccccccggcgaggagtacctggaggactggggccagggcaccctggtgatcgtgagcagc

SEQ ID NO: 32021 - RNA, 393 nt, synthetic construct
  misc_feature 1..393: note = derived and/or modified sequence opt4 from anti-HIV_10E8
  source 1..393: mol_type = other RNA
gaggtgagactggtggagagcggcggcggcctggtgaagcccggcggcagcctgagactgagctgcagcgccagcggcttcaacttcgacgacgcctggatgacctgggtgagacagccccccggcaagggcctggagtgggtgggcagaatcagcggccccggcgagggctggagcgtggactacgccgagagcgtgaagggcagattcaccatcagcagactgaacagcatcaacttcctgtacctggagatgaacaacgtgagaaccgaggacaccggctactacttctgcgccagaaccggcaagcactacgacttctggagcggctacccccccggcgaggagtacttccaggactggggccagggcaccctggtgatcgtgagcagc

SEQ ID NO: 32022 - RNA, 393 nt, synthetic construct
  misc_feature 1..393: note = derived and/or modified sequence opt4 from anti-HIV_10E8
  source 1..393: mol_type = other RNA
gaggtgagactggccgagagcggcggcggcctggtgaagcccggcggcagcctgagactgagctgcagcgccagcggcttcgacttcgacaacgcctggatgacctgggtgagacagccccccggcaagggcctggagtgggtgggcagaatcaccggccccggcgagggctggagcgtggactacgccgcccccgtggagggcagattcaccatcagcagactgaacagcatcaacttcctgtacctggagatgaacaacctgagaatggaggacagcggcctgtacttctgcgccagaaccggcaagtactacgacttctggagcggctacccccccggcgaggagtacttccaggactggggccagggcaccctggtgatcgtgcccagc

SEQ ID NO: 32023 - RNA, 393 nt, synthetic construct
  misc_feature 1..393: note = derived and/or modified sequence opt4 from anti-HIV_10E8
  source 1..393: mol_type = other RNA
gaggtgagactggtggagagcggcggcggcctggtgaagcccggcggcagcctgagactgagctgcagcgccagcggcttcgacttcgacaacgcctggatgacctgggtgagacagccccccggcaagggcctggagtgggtgggcagaatcaccggccccggcgagggctggagcgtggactacgccgcccccgtggagggcagattcaccatcagcagactgaacagcatcaacttcctgtacctggagatgaacaacctgagaatggaggacagcggcctgtacttctgcgccagaaccggcaagtactacgacttctggagcggctacccccccggcgaggagtacttccaggactggggccagggcaccctggtgatcgtgcccagc

SEQ ID NO: 32024 - RNA, 393 nt, synthetic construct
  misc_feature 1..393: note = derived and/or modified sequence opt4 from anti-HIV_10E8
  source 1..393: mol_type = other RNA
gaggtgagactggtggagagcggcggcggcctggtgaagcccggcggcagcctgagactgagctgcagcgccagcggcttcgacttcgacaacgcctggatgacctgggtgagacagccccccggcaagggcctggagtgggtgggcagaatcaccggccccggcgagggctggagcgtggactacgccgcccccgtggagggcagattcaccatcagcagactgaacagcatcaacttcctgtacctggagatgaacaacctgagaatggaggacagcggcctgtacttctgcgccagaaccggcaagtactacgacttctggagcggctacccccccggcgaggagtacttccaggactggggccagggcaccctggtgatcgtgagcagc

SEQ ID NO: 32025 - RNA, 393 nt, synthetic construct
  misc_feature 1..393: note = derived and/or modified sequence opt4 from anti-HIV_10E8
  source 1..393: mol_type = other RNA
gaggtgagactggccgagagcggcggcggcctggtgaagcccggcggcagcctgagactgagctgcagcgccagcggcttcgacttcgacaacgcctggatgacctgggtgagacagccccccggcaagggcctggagtgggtgggcagaatcaccggccccggcgagggctggagcgtggactacgccgcccccgtggagggcagattcaccatcagcagactgaacagcatcaacttcctgtacctggagatgaacaacctgagaatggaggacagcggcctgtacttctgcgccagaaccggcaagtactacgacttctggagcggctacccccccggcgaggagtacttccaggactggggcagaggcaccctggtgatcgtgagcagc

SEQ ID NO: 32026 - RNA, 393 nt, synthetic construct
  misc_feature 1..393: note = derived and/or modified sequence opt4 from anti-HIV_10E8
  source 1..393: mol_type = other RNA
gaggtgagactggtggagagcggcggcggcctggtgaagcccggcggcagcctgagactgagctgcagcgccagcggcttcgacttcgacaacgcctggatgacctgggtgagacagccccccggcaagggcctggagtgggtgggcagaatcaccggccccggcgagggctggagcgtggactacgccgcccccgtggagggcagattcaccatcagcagactgaacagcatcaacttcctgtacctggagatgaacaacctgagaatggaggacagcggcctgtacttctgcgccagaaccggcaagtactacgacttctggagcggctacccccccggcgaggagtacttccaggactggggcagaggcaccctggtgatcgtgagcagc

SEQ ID NO: 32027 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagaagcagcaacatcggcaacaacaacgtgttctggtaccagcagctgcccggcaccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32028 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagcccgccagcgtgagcggcagccccggccagagcatcaccatcagctgcaccggcaccaagagcgacatcggcggctacaagtacgtgagctggtaccagcagcaccccggcaaggcccccaagatcctgatctacgacgtgaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32029 - RNA, 321 nt, synthetic construct
  misc_feature 1..321: note = derived and/or modified sequence opt4 from anti-HIV-1_LightChain
  source 1..321: mol_type = other RNA
cagagcgtgctgacccagccccccagcgtgagcgccgcccccggccagagagtgaccatcagctgcttcggcagcagattcagcagcgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32030 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagaccatcaccatcagctgcagcggcagcagcagcaacatcggcagcaacgacgtgtactggtaccagcacctgcccggcaccacccccaaggtggtgatctacaagaacaacagaagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32031 - RNA, 327 nt, synthetic construct
  misc_feature 1..327: note = derived and/or modified sequence opt4 from anti-HIV-1_LightChain
  source 1..327: mol_type = other RNA
cagagcgtgctgacccagccccccagcatgagcgccgcccccggccagaaggtgaccatcagctgcagcggcagcaccagcatcatcggcaacaactacatcagctggtaccagcagctgcccggcaccgcccccaagctgctgatctacgaggacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgacc

SEQ ID NO: 32032 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggcctgaaggtgaccatcagctgcagcggcaacaccagcaacgtgggcgacaacttcgtgagctggtacagatacctgcccggcaccgcccccaagctgctgagctacgaggacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32033 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcagcaacaccgtgaactggtaccagcagttccccggcaccgcccccaagctgctgatctacgagaacaacagaagacccagcggcgtgcccgccagattcagcggcagcaagagcggcaccagcgccaccctggccatcaccggcctgcagaccggcgacgaggccgactactactgcgccacctgggacagcagcctgagcgccggcggcgtgttcggcaccggcaccaaggtgaccgtgctg

SEQ ID NO: 32034 - RNA, 318 nt, synthetic construct
  misc_feature 1..318: note = derived and/or modified sequence opt4 from anti-HIV-1_LightChain
  source 1..318: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcacc

SEQ ID NO: 32035 - RNA, 288 nt, synthetic construct
  misc_feature 1..288: note = derived and/or modified sequence opt4 from anti-HIV-1_LightChain
  source 1..288: mol_type = other RNA
ggcctgagccccagcctgtgcagcggcagcagcagcaacatcggcaacaactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32036 - RNA, 333 nt, synthetic construct
  misc_feature 1..333: note = derived and/or modified sequence opt4 from anti-HIV-1_LightChain
  source 1..333: mol_type = other RNA
cagttcgtgctgacccagccccccagcgtgagcgccgcccccggccagagagtgaccgtgagctgcagcggcaccaccagcgacatcggcgagaactacgtgagctggtaccagaagttcagcgaggccgcccccaagctgctgctgtacgacaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32037 - RNA, 327 nt, synthetic construct
  misc_feature 1..327: note = derived and/or modified sequence opt4 from anti-HIV-1_LightChain
  source 1..327: mol_type = other RNA
cagagcgtgctgacccagccccccagcgtgagcgccgcccccggccagaaggtgaccatcagctgcagcggcggcagcagcaacatcggcaactactacgtgagctggtacctgcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgacc

SEQ ID NO: 32038 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcaacatgagcaacatcggcgacaacgccgtgagctggtacagacaggtgcccgaggcccccccccagctgctgatcttcggcaacgacaagagacccagcggcgtgaccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32039 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcaccggcagcagcagcaacatcggcgccggctacgacgtgcactggtacctgcagctgcccggcaccgcccccagactgctgatctacgacaacgacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32040 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcaccagcaacatcggcaacaacttcgtgagctggtaccagcagctgcccggcaccgcccccaagctgctgttctacgacaactacaagagacccagcggcatccccgacagattcagcggcagcaagagcggcaccagcgccaccctggccatcaccggcctgcagaccggcgacgaggccgactactactgcgccacctgggacagcagcctgagcgccggcggcgtgttcggcaccggcaccaaggtgaccgtgctg

SEQ ID NO: 32041 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcaccggcggcagcagcaacatcggcgccggctacgacgtgcactggtaccagcacctgcccggcaccgccccccagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32042 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcctgagcgccgcccccggccagagagtgaccgtgagctgcagcggcagcagcagcaacatcggcgacaactacgtgagctggtaccagcagctgcccggcgccgcccccagactgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32043 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagaagcagcaacatcggcaactacttcgtgagctggtaccagcagttccccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32044 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcagcaacgccgtgcactggttcagacagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcgccacctgggacagcagcctgagcgccggcggcgtgttcggcaccggcaccaaggtgaccgtgctg

SEQ ID NO: 32045 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgccagcggccagaaggtgaccatcagctgcagcggcagcagcagcaacatcggcaacaactacgtgagctggtaccaccagctgcccggcaccgcccccaagctgctgatctacgacaccaacaagagacccagcggcatccccgacagattcagcggcagcaccagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32046 - RNA, 333 nt, synthetic construct
  misc_feature 1..333: note = derived and/or modified sequence opt4 from anti-HIV-1_LightChain
  source 1..333: mol_type = other RNA
cagcccgtgctgacccagccccccagcgtgagcgccgcccccggccagaccgtgaccatcagctgcagcggcagcttcagcaacatcgagaccaactacgtgagctggtaccagcagctgcccggcaccgcccccaagctgctgatctacgacaacaacatgagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32047 - RNA, 336 nt, synthetic construct
  misc_feature 1..336: note = derived and/or modified sequence opt4 from anti-HIV-1_LightChain
  source 1..336: mol_type = other RNA
cagcccgtgctgacccagccccccagcgtgagcggcgcccccggccagagagtgaccatcagctgcaccggcagcagcagcaacatcggcgccggctacgacgtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32048 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcctgagcgccgcccccggccagagaatcaccatcagctgcagcggcagcagcagcaacatcggcaacaactacgtgagctggtaccagcagttccccggcaccgcccccaagctgctgatctacgagaacaacaagagacccagcggcatccccgacagattcagcgccagcaagagcggcaccagcgccaccctgggcatcaccggcctgcagaccggcgacgaggccaactactactgcggcacctggcacagcagcctgagcgccggcggcgtgttcggcaccggcaccaaggtgaccgtgctg

SEQ ID NO: 32049 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcttcggcagcagattcaacgtgggcaccagcagcgtgagctggtaccagcagctgcccggcaccgcccccaagctgctgatcgacgccaacggcgagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32050 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccacccccggccagaaggtgaccatcagctgcagcggcagcagaagcaacatcggcagccactacgtgagctggtaccagcagttccccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32051 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcagcaaccacgtgtactggtaccagcagctgcccggcaagacccccaagctgctgatctacagaaacaaccagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32052 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcgccaacatcggcaacaactacgtgagctggtaccagcagttccccggcaccggccccagactgatcatctacgagagcaacaagagacccagcggcatcagcgacagattcagcggcagccagagcgacgccgccgccaccctggacatcaccggcctgcagaccggcgacgaggccgactactactgcggcacctgggacagcagcctgagcgccggcggcgtgttcggcaccggcaccagagtgaccgtgctg

SEQ ID NO: 32053 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagaccgtgaccatcagctgcaccggcgacaccagcaacatcggcgccgactacagagtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32054 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcctgagcgccgcccccggccagagagtgaccgtgagctgcagcggcagcagcagcaacatcggcaacaactacgtgagctggtaccagcagctgcccggcgccgcccccaagctgctgatctacaacaacaacatcagacccagcggcatccccgagagattcagcggcagcaagagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32055 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcggcaactacgtgagctggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32056 - RNA, 333 nt, synthetic construct
  misc_feature 1..333: note = derived and/or modified sequence opt4 from anti-HIV-1_LightChain
  source 1..333: mol_type = other RNA
cagagcctgctgacccagccccccagcgtgagcgccgcccccggccagaaggtgaccatcagctgcagcggcagcagcagcaacatcggcaacaacttcgtgagctggtaccagcagctgcccggcaccgcccccaagctgctgatctacgagaacaacatgagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32057 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcaccagcagcaacatcgccaactactacgtgagctggtacagacagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32058 - RNA, 333 nt, synthetic construct
  misc_feature 1..333: note = derived and/or modified sequence opt4 from anti-HIV-1_LightChain
  source 1..333: mol_type = other RNA
cagcccgtgctgacccagccccccagcgtgagcggcgcccccggccagagagtgaccatcagctgcagcggcagcagcagcaacatcggcaacaacgacgtgagctggtaccagcaggtgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32059 - RNA, 333 nt, synthetic construct
  misc_feature 1..333: note = derived and/or modified sequence opt4 from anti-HIV-1_LightChain
  source 1..333: mol_type = other RNA
cagctggtgctgacccagccccccagcgtgagcgccgcccccggccagagagtgaccatcagctgcttcggcagcagattcaacgtgggcaccagcagcgtgagctggtaccagcagctgcccggcaccgcccccaagctgctgatcgacgccaacggcgagagacccagcggcatccccgacagattcttcggcagcgagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32060 - RNA, 333 nt, synthetic construct
  misc_feature 1..333: note = derived and/or modified sequence opt4 from anti-HIV-1_LightChain
  source 1..333: mol_type = other RNA
agctacgagctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32061 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcaccagcaacatcggcacctactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32062 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccgccagcgtgagcgccagccccggccagagcatcgccatcagctgcaccggcaccagcagcgacgtgggcagctacaactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32063 - RNA, 330 nt, synthetic construct
  misc_feature 1..330: note = derived and/or modified sequence opt4 from anti-HIV-1_LightChain
  source 1..330: mol_type = other RNA
cagagcgtgctgacccagccccccagcgtgagcgccgcccccggccagagagtgaccatcagctgcagcggcggcagcagcaacatcggcaacaaccacgtgagctggtaccagcacctgcccggcagagccccccagctgctgatctacgacaccacccagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtg

SEQ ID NO: 32064 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcagcaagtacgtgtgctggtaccagcagctgcccggcaccgcccccaagctgctgatctacagaaacaaccagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32065 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcgacagcagcaccttcgagaacgactacgtgtgctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32066 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacggcaacagcaacagacccagcggcgtgcccgacagattcagcggcagcaagagcggcaccagcgccagcctggccatcaccggcctgcaggccgaggacgaggccgactactactgcggcacctgggacagcagcctgagcgccggcggcgtgttcggcaccggcaccaaggtgaccgtgctg

SEQ ID NO: 32067 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaccgtgaccatcagctgcagcggcagcagcagcaacatcggcagcaacaccgtgaactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32068 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcttctgcaccggcagcagcagcaacgtgggcggcggctacgacgtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32069 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccctgagctgcagcggcagcagcagcaacatcggcaacaacagcgtgagctggtaccagcagttccccggcaccgcccccaagctgctgatctacgacagcgacaagagacccagcggcatccccgacagattcagcggcagcaagagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32070 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagaaggtgaccatcagctgcagcggcagcagcagccagatcggcagcaacagcgtgtactggtaccagcagctgcccggcaccacccccaagctgctgatctacggcaacaaccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32071 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccgccagcgtgagcggcagccccggccagagcatcaccatcagctgcaccggcaccggcagcgacgtgggcggctacaaccacgtgagctggtaccagcagcaccccggcaaggcccccaagctgctgatctacgacaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32072 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcagcggcagcggcagcaacatcggcgacagattcgtgagctggtaccagcacctgcccggcaccgtgcccaagctgctgatctacgacaacgagcacagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32073 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaagatcaccatcagctgcagcggcagcagcagcaacatcggcaagagcgtggtgagctggtacagacagttccccggcaccgcccccaagctgctgatctacgacacctacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32074 - RNA, 333 nt, synthetic construct
  misc_feature 1..333: note = derived and/or modified sequence opt4 from anti-HIV-1_LightChain
  source 1..333: mol_type = other RNA
cagcccgtgctgacccagccccccagcgccagcggcacccccggccagagagtgaccatcagctgcagcggcagcagcagcaacatcggcggcaacaccgtgaactggtaccagcagttccccggcgccgcccccagactgctgatctacgaggacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32075 - RNA, 333 nt, synthetic construct
  misc_feature 1..333: note = derived and/or modified sequence opt4 from anti-HIV-1_LightChain
  source 1..333: mol_type = other RNA
aacttcatgctgacccagccccacagcgtgagcgagagccccggcaagaccgtgaccatcagctgcaccagaagcagcggcagcgtggccagcaactacgtgcagtggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32076 - RNA, 333 nt, synthetic construct
  misc_feature 1..333: note = derived and/or modified sequence opt4 from anti-HIV-1_LightChain
  source 1..333: mol_type = other RNA
cagagcatgctgacccagccccccagcgtgagcgccgcccccggccagagagtgaccgtgagctgcagcggcagcagcagcaacatcggcagccacttcgtgagctggtaccagcagctgcccggcaccgcccccaagctgctgatctacgacaacagcaacagacccagcgccatccccgacagattcagcggcagcaagagcggcaccagcgccaccctgggcatcagcggcctgcacaccggcgacgaggccgactactactgcgccacctgggacaacagcctgagcaccggcggcgtgttcggcaccggcaccaaggtgaccgtgctg

SEQ ID NO: 32077 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgatcatcagctgcagcggcggcagcagcaacatcggcaacaacttcgtgagctggtaccaccagctgcccggcaccgcccccaagctgctgatctacgagaacaccaagagacccagcaagatccccgccagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32078 - RNA, 315 nt, synthetic construct
  misc_feature 1..315: note = derived and/or modified sequence opt4 from anti-HIV-1_LightChain
  source 1..315: mol_type = other RNA
cagagcctgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggc

SEQ ID NO: 32079 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccgccagcgtgagcggcagccccggccagagcatcaccatcagctgcaccggcaccagcagcgacatcggcagctacagcttcgtgagctggtaccagcagcaccccggcaaggcccccaagctgatcatctacgacgtgaacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32080 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcaccggcaacagcagcaacatcggcgccggcttcgacgtgcactggtacagacacctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32081 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcggcagcagcaacatcggcaactactacgtgagctggtacctgcagctgcccggcgccgcccccaagctgctgatctacgacaccgacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32082 - RNA, 333 nt, synthetic construct
  misc_feature 1..333: note = derived and/or modified sequence opt4 from anti-HIV-1_LightChain
  source 1..333: mol_type = other RNA
cagagcgtgctgaccagaccccccagcgtgagcgccgcccccggccagaaggtgaccatcagctgcagcggcagaagcagcaacatcggcaacaactacgtgagctggtaccagcagctgcccggcgccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32083 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcaccatcagcaacatcggcgccaacctggtgagctggtacagacagctgcccggcaccgtgcccaccgtgctgatccacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32084 - RNA, 327 nt, synthetic construct
  misc_feature 1..327: note = derived and/or modified sequence opt4 from anti-HIV-1_LightChain
  source 1..327: mol_type = other RNA
cagagcgtgctgacccagccccccagcgtgagcgccgcccccggccagaaggtgaccatcagctgcagcggcagcagcagcaacatcggcaacaacttcgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgacc

SEQ ID NO: 32085 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagagccccagcgtgagcgccgcccccggccagagagtgaccatcagctgcagcggcggcagcagcaacatcggcagcaacgccgtgagctggtaccagcagctgcccggcaccgcccccaagctgctgatctacggcgacaccatgagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32086 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagcaggtgaccatcagctgcagcggcaccaccagcaacatcggcaccaactacgtgagctggtaccagcagatgccccccgccgcccccaagctgctgatctacgacaacaagaagagacccagcgacatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32087 - RNA, 333 nt, synthetic construct
  misc_feature 1..333: note = derived and/or modified sequence opt4 from anti-HIV-1_LightChain
  source 1..333: mol_type = other RNA
cagagcgtggtgacccagagccccagcgccagcggcacccccggccagagagtgatcatcagctgcagcggcagcagcagcaacatcggcaacatctacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32088 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcatgagcgccgcccccggccagaaggtgaccatcagctgcagcggcagcaccagcatcatcggcaacaactacatcagctggtaccagcagctgcccggcaccgcccccaagctgctgatctacgaggacaacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32089 - RNA, 336 nt, synthetic construct
  misc_feature 1..336: note = derived and/or modified sequence opt4 from anti-HIV-1_LightChain
  source 1..336: mol_type = other RNA
cagagcgccctgacccagccccccagcgccagcggcagcagaggccagagcgtgatcatcagctgcaccggcaccagcagcgacgtgggcgtgtacaacctggtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32090 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcatgagcgccgcccccggccagagcgtgagcatcagctgcagcggcagcagcgacaacatcgagagaaaccaggtgatctggctgagacaggtgcccggcgccgcccccaccgtgctgatcatcttcaacaacagaagacccagcggcgtgcccgacagattcagcggcagcagaagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32091 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaccgtgaccatcagctgcagcggcagcttcagcaacatcgagaccaactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32092 - RNA, 333 nt, synthetic construct
  misc_feature 1..333: note = derived and/or modified sequence opt4 from anti-HIV-1_LightChain
  source 1..333: mol_type = other RNA
cagagcctgctgacccagccccccagcgtgagcgccgcccccggccagaaggtgaccatcagctgcagcggcagcagcagcaacatcggcagcaagtacgtgtgctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32093 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccagaagcgtgagcggcagccccggccagagcgtgaccatcagctgcaccggcaccaccagcgacgtgggcggctacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32094 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcaccggcttcaccagcaacatcggcctgaactacgtgagctggtaccagcaggtgcccggcaccacccccaagctggtgatcttcgagaacgacagaagattcctgggcatccccgacagattcagcggcagcaagagcggcgccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32095 - RNA, 333 nt, synthetic construct
  misc_feature 1..333: note = derived and/or modified sequence opt4 from anti-HIV-1_LightChain
  source 1..333: mol_type = other RNA
cagagcgtgctggcccagccccccagcgtgagcgccgcccccggccagaaggtgaccatcagctgcagcggcagaaccagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32096 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagcccaccagcgtgagcgccgcccccggcagatgggtgaccgtgagctgcagcggcaccagaagcaacatcggcgaccacagcgtgagctggttccagcacctgcccggcgccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32097 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcgacaactacgtgagctggtaccagcagttccccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32098 - RNA, 333 nt, synthetic construct
  misc_feature 1..333: note = derived and/or modified sequence opt4 from anti-HIV-1_LightChain
  source 1..333: mol_type = other RNA
caggccctgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32099 - RNA, 333 nt, synthetic construct
  misc_feature 1..333: note = derived and/or modified sequence opt4 from anti-HIV-1_LightChain
  source 1..333: mol_type = other RNA
cagctggtgctgacccagccccccagcgccagcggcacccccggccagagagtgaccatcagctgcagcggcagcaccagcaacatcggcacctactacgtgtactggtaccagctgctgcccggcaccacccccaaggtgctgatctacgccaacgaccagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32100 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcaccagcagcaacatcggcaacaacttcgtgagctggtaccagagactgcccggcaccgcccccaagctgctgatcttcgagaacgacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32101 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagagccccagcgtgagcgccacccccggccagagagtgaccatcagctgcagcggcaacaccagcaacatcggcaagaacttcgtgagctggtaccagcagttccccggcaccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32102 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggcagagaggtgatcatcagctgcagcggcagcagcagcaacatcggcaacaaccacgtgagctggtaccagcagctgcccggcaccgcccccaaggtgctgatctacgagagcaacaagagacacagcggcatccccgacagattcagcggcagcaagagcggcaccagcgccaccctggccatcaccggcctgcagaccggcgacgaggccgactactactgcggcgcctgggacagcagcctgagcgccggcggcgtgttcggcaccggcaccaaggtgaccgtgctg

SEQ ID NO: 32103 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcgacagcaccgtgaactggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32104 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcaccagcaacatcggcaacaactacgtgagctggtaccagcagctgcccggcaccgcccccaagctgctgatctacgagaacaacagacagcccagcggcatccccgacagattcagcggcagcaagagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32105 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcagcaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgtgtactactgcggcacctgggacagcagcctgaccgccggcggcgtgttcggcagcggcaccaaggtgaccgtgctg

SEQ ID NO: 32106 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcatcggcagcagcagcaacatcggcgccgactacagagtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32107 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagaatcaccgtgagctgcaccggcaccagcagcaacatcggcgccccctacgacgtgaactggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32108 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccgccatgagcgccgcccccggccagagcgtgaccatcagctgcagcggcagcgccttcaacatcgagagacaccaggtgacctggctgagacacctgcccggcaccgcccccaccagcgtgatcatcatgaacaaccagagacccagcggcgtgcccgacagattcagcggcagcagaagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32109 - RNA, 333 nt, synthetic construct
  misc_feature 1..333: note = derived and/or modified sequence opt4 from anti-HIV-1_LightChain
  source 1..333: mol_type = other RNA
cagagcgtgctggcccagccccccagcgccagcggcacccccggccagagagtgaccatcagctgcagcggcagcgccagcaacatcggcttcaacagcgtgacctggtaccagcagctgcccggcaccgcccccaccgtgctgatctacggcaacgacctgagacccagcggcatccccgacagattcagcggcagcaagagcggcaccagcgccaccctgggcatcaccggcctgcagaccggcgacgagggcgactactactgcggcacctgggacagaagcctgagcgccggcggcgtgttcggcaccggcaccaaggtgaccgtgctg

SEQ ID NO: 32110 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccgccagcgtgagcggcagccccggcgagagcatcaccatcagctgcaccggcaccagaagcgacatcggcaactacgcctacgtgagctggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32111 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccccccccggccagaaggtgaccatcagctgcagcggcaccaccagcaacatcggcagcaactacgtggcctggtaccagcagctgcccggcaccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32112 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagagccccagcgtgagcggcacccccggccagagagtgaccatcttctgcagcggcagcgacagcgacatcggcatcaacagcgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32113 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcaacagcagcaacatcggcaacaactacgtgagctggtaccagcacctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32114 - RNA, 333 nt, synthetic construct
  misc_feature 1..333: note = derived and/or modified sequence opt4 from anti-HIV-1_LightChain
  source 1..333: mol_type = other RNA
cagagcctgctgacccagccccccagcgtgagcgccgcccccggccagaaggtgaccatcagctgcagcggcggcaacagcgacatcggcaagaacttcgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32115 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgatcatcagctgcagcggcagcagcagcaacatcggcaagaactacgtggcctggtaccagcagctgcccggcaccgcccccaagctgctggtgtacgagaacaccaacagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32116 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcatgagcgacatcggcctgaaccccgtgagctggtacagacagctgcccgaggcccccccccacctgctgatcttcgacaacgacgagagacccagcggcaccgccggcagattcagcgccagcaagagcggcaccagcgccaccctggacatcaccggcctgcagaccggcgacgaggccgactactactgcggcacctgggacagcagcctgagcgccggcggcgtgttcggcaccggcaccaaggtgaccgtgctg

SEQ ID NO: 32117 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccgccagcgtgagcggcagccccggccagagcatcaccatcagctgcaccggcaccagcagcgacgtgggcagctacaacctggtgagctggtaccagcagtaccccggcagagcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32118 - RNA, 333 nt, synthetic construct
  misc_feature 1..333: note = derived and/or modified sequence opt4 from anti-HIV-1_LightChain
  source 1..333: mol_type = other RNA
cagagcctgctgacccagccccccagcgtgagcgccagccccggccagaaggtgaccatcagctgcagcggcaccagcagcaacatcggcaacaactacgtgagctggtaccagcagttccccggcaccgcccccaagctgctgatctacgagaacaacaagagaagcagcggcatccccgacagattcagcggcagcaagagcgacaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32119 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcaccggcagaagaagcaacatcggcgccggctacgacgtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32120 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcagcggcagcagcagcaacatcggcaacaacttcgtgagctggtaccagttcttccccggcaccgcccccaagctggtgatctacgagaacgacaagagacccagcggcacccccgacagattcagcggcagcaagagcggcaccagcgccaccctggccatcatcggcctgcagaccggcgacgagggcgactactactgcggcacctgggacaacagcctgagcaccggcggcgtgttcggcaccggcaccaaggtgaccgtgctg

SEQ ID NO: 32121 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcagcggcggcagcagcaacatcggcaacaaccacgtgagctggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32122 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcagagacttcgtgagctggtaccagcaggtgcccggcaccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32123 - RNA, 336 nt, synthetic construct
  misc_feature 1..336: note = derived and/or modified sequence opt4 from anti-HIV-1_LightChain
  source 1..336: mol_type = other RNA
cagaccgtggtgacccagccccccagcgtgagcggcgcccccggccagaccgccaccatcagctgcaccggcagcagcagcaacatcggcgccgactacgacgtgcactggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32124 - RNA, 333 nt, synthetic construct
  misc_feature 1..333: note = derived and/or modified sequence opt4 from anti-HIV-1_LightChain
  source 1..333: mol_type = other RNA
aacttcatgctgacccagccccccagcgccagcggcacccccggccagagagtgaccatcagctgcagcggcagcagcagcaacatcggcagcaactacgtgtactggtaccagcagctgcccggcaccacccccaagctgctgatctacagaaacaaccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32125 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagccccaacatcggcaacaacttcctgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32126 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagagccccagcgtgagcgccgcccccggccagaaggtgaccatcagctgcagcggcagcagcagcgacatcggcaacaacttcgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32127 - RNA, 333 nt, synthetic construct
  misc_feature 1..333: note = derived and/or modified sequence opt4 from anti-HIV-1_LightChain
  source 1..333: mol_type = other RNA
cagttcttcctgacccagccccccagcctgagcgccacccccggccagagagtgagcatcagctgcagcggcggcggcagcaacatcgccaacaacgacgtgttctggttccagcagttccccggcgccggccccagactgctgatctacgacaacctgaagagacactacggcacccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32128 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcggccccaacatcggcagcaacagcgtgagctggtaccagcacttccccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32129 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagagccccagcgccagcggcacccccggccagagagtgaccatcagctgcagcggcagcagcagcaacatcggcagcaacaccgtgagctggttccagcacctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32130 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcggcgcccccggccagaacgtgatcatcagctgcagcggcagcagcagcaacatcggcaagaactacgtggcctggtaccagcagctgcccggcaccgcccccaagatcgtgatctacgagaccaccaacagacccagcggcatccccgccagattcagcggcagcaagagcggcaccagcgccaccctgggcatcaccggcctgcaggccggcgacgaggccgactactactgcggcacctgggacagcagcctgaacgccggcggcgtgttcggcaccggcaccaaggtgaccgtgctg

SEQ ID NO: 32131 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcaacaacttcctgagctggtaccagcacctgcccggcaccgcccccagactgctgatctacgacaacgaccagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32132 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32133 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcaccaccagcaacatcggcaaccactacgtgagctggtaccagcagttccccggcaccgcccccaagctgatcatctacgagaccgacagaagacccagcggcatccccgccagattcagcggcagcaagagcggcaccagcgccaccctggccatcgccggcctgcagaccggcgacgaggccgactactactgcggcacctgggacagcagcctgagcaccggcggcgtgttcggcaccggcaccaaggtgaccgtgctg

SEQ ID NO: 32134 - RNA, 333 nt, synthetic construct
  misc_feature 1..333: note = derived and/or modified sequence opt4 from anti-HIV-1_LightChain
  source 1..333: mol_type = other RNA
cagctggtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32135 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcagcggcggcagcagcaacatcggcaacaaccacgtgagctggtaccagcacctgcccggcagagccccccagctgctgatctacgacaccacccagagacccagcagaatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32136 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaagatcaccatcagctgcagcggcagcagaagcaacatcggcaacaactacgtgagctggtaccagcagttccccggcaccgcccccaagctgctgatctacgacaacaaccagagacccagcagaatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32137 - RNA, 321 nt, synthetic construct
  misc_feature 1..321: note = derived and/or modified sequence opt4 from anti-HIV-1_LightChain
  source 1..321: mol_type = other RNA
cagagcgtgctgacccagccccccagcgtgagcgccgcccccggccagagagtgaccatcagctgcttcggcagcagattcagcagcgtgagctggtaccagcagctgcccggcaccgcccccaagctgctgatctaccccaacggcgagagacccagcggcatccccgacagattcttcggcagcgagagcggcaccagcgccaccctgggcatcaccggcctgcagaccggcgacgaggccgactactactgcgccacctgggacagcagcctgagcgccggcggcgtgttcggcaccggcaccaagctgaccgtgctg

SEQ ID NO: 32138 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcctgagcgccgcccccggccagaaggtgaccatcagctgcagcggcagcagcctgaacatcggcaaccactacgtgagctggtaccagcaggtgcccggcaccgcccccaagctgctgatctacgaggacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32139 - RNA, 333 nt, synthetic construct
  misc_feature 1..333: note = derived and/or modified sequence opt4 from anti-HIV-1_LightChain
  source 1..333: mol_type = other RNA
cagttcgtgctgacccagccccccagcgtgagcgccgcccccggccagaaggtgaccgtgagctgcagcggcaccaccagcgacatcggcgagaactacgtgagctggtaccagaagttccccgaggccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32140 - RNA, 333 nt, synthetic construct
  misc_feature 1..333: note = derived and/or modified sequence opt4 from anti-HIV-1_LightChain
  source 1..333: mol_type = other RNA
ctgagcgtgctgacccagccccccagcgtgagcgccgcccccggccagcaggtgaccatcagctgcagcggcaccaccagcaacatcggcaccaactacgtgagctggtaccagcagatgccccccaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32141 - RNA, 336 nt, synthetic construct
  misc_feature 1..336: note = derived and/or modified sequence opt4 from anti-HIV-1_LightChain
  source 1..336: mol_type = other RNA
cagagcatgctgacccagccccccagcgtgagcggcgcccccggccagagagtgaccatcagctgcaccggcagcagaagcaacatcggcgccggctacgacgtgcactggtacctgcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32142 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccacccccggccagaaggtgaccatcagctgcagcggcagcagaagcaacatcggcagccactacgtgagctggtaccagcagttccccgagagcgcccccaccctgctgatctacgagaacgtggagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32143 - RNA, 333 nt, synthetic construct
  misc_feature 1..333: note = derived and/or modified sequence opt4 from anti-HIV-1_LightChain
  source 1..333: mol_type = other RNA
cagttcttcctgacccagccccccagcctgagcgccacccccggccagagagtgagcatcagctgcagcggcggcggcagcaacatcgccaacaacgacgtgttctggttccagcagttccccggcgccggccccagactgctgatctacgacaacctgaagagacactacggcacccccgacagattcagcggcagcaagagcggcgccaccggcaccctggagatcaccgaggtgcagaccgccgacgaggccgactactactgcggcacctgggacagcagcctgagcgccggcggcgtgttcggcaccggcaccaaggtgaccgtgctg

SEQ ID NO: 32144 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcggcagcagcaacatcggcgacaacagcgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcaccggcggcgtgttcggcaccggcaccaaggtgaccgtgctg

SEQ ID NO: 32145 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaccgtgaccatcagctgcagcggcagcgccagcaacatcggcagaaacagcgtgagctggtaccagtacgtgcccggcgccgcccccaagagactgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 32146 - RNA, 333 nt, synthetic construct
  misc_feature 1..333: note = derived and/or modified sequence opt4 from anti-HIV-1_LightChain
  source 1..333: mol_type = other RNA
cagagcgtgctggcccagccccccagcgtgagcgccgcccccggccagaaggtgaccatcagctgcagcggcagaaccagcaacatcggcaactacttcgtgagctggtaccagcagttccccggcaccgcccccagactgctgatctacgacaacgaccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32147 - RNA, 333 nt, synthetic construct
  misc_feature 1..333: note = derived and/or modified sequence opt4 from anti-HIV-1_LightChain
  source 1..333: mol_type = other RNA
cagagcgccctgacccagcccgccagcgtgagcgccgcccccggccagaaggtgaccatcagctgcagcggcagcagcagcaacatcggcaacatctacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32148 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccacccccggccagagagtgaccgtgagctgcagcggcagcagcagcaacatcggcaaccactacgtgagctggtaccagcaggtgcccggcaccgcccccaagctgctgatctacgacaacagcaacagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32149 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcctgagcgccgcccccggccagagagtgaccgtgagctgcagcggcagcagcagcaacatcggcgacaactacgtgagctggtaccagcagctgcccggcgccgcccccagactgctgatctacgacaacagcatcagacccagcgccatccccgccagattcagcggcagcaagagcggcaccagcgccaccctggccatcaccggcctgcagaccggcgacgaggccgactactactgcggcacctgggacagcagcctgagcgccggcggcgtgttcggcaccggcaccaaggtgaccgtgctg

SEQ ID NO: 32150 - RNA, 336 nt, synthetic construct
  misc_feature 1..336: note = derived and/or modified sequence opt4 from anti-HIV-1_LightChain
  source 1..336: mol_type = other RNA
cagagcgccctgacccagcccgccagcgtgagcggcagccccggccagagcatcaccatcagctgcaccggcaccagcagcgacgtgggcggctacgactacgtgagctggtacctgcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32151 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccgtgagctgcagcggcagcagcagcaacatcggcaacaactacgtgagctggtaccagcagttccccggcaccgcccccaagctggtgatctacgacaccgacaagagacccagcggcatccccgacagattcagcggcagcaagagcggcaccagcgccaccctgggcatcaccggcctgcagaccggcgacgaggccgactactactgcgccacctgggacagcagcctgagcgccggcggcgtgttcggcaccggcaccaaggtgaccgtgctg

SEQ ID NO: 32152 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcaccggcaacagcagcaacatcggcgccggctacgacgtgcactggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32153 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcggcacccccggccagagagtgaccatcagctgcagcggcagcagcagcaacatcggcagcaactacgtggactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32154 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccacccccggccagaccgtgaccatcagctgcagcggcagcagcagcaacatcggcaacaactacctgagctggtacagacagctgcccagaaccgcccccaagctgctgatctacgagaacaacagaagacccagcggcgtgcccgccagattcagcggcagcaagagcggcaccagcgccaccctggccatcaccggcctgcagaccggcgacgaggccgactactactgcggcacctgggacagcagcctgagcgccggcggcgtgttcggcaccggcaccaaggtgaccgtgctg

SEQ ID NO: 32155 - RNA, 321 nt, synthetic construct
  misc_feature 1..321: note = derived and/or modified sequence opt4 from anti-HIV-1_LightChain
  source 1..321: mol_type = other RNA
cagagcgtgctgacccagccccccagcgtgagcgccgcccccggccagagagtgaccatcagctgcttcggcagcagattcagcagcgtgagctggtaccagcagctgcccggcaccgcccccaagctgctgatctaccccaacggcgagagacccagcggcatccccgacagattcttcggcagcgagagcggcaccagcgccaccctgggcatcaccgccgtgcagaccggcgacgaggccgactactactgcggcacctgggacgacagcctgagcaccggcggcgtgttcggcaccggcaccaaggtgaccgtgctg

SEQ ID NO: 32156 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccctgagctgcagcggcaccagcagcaacatcggcaacaactacgtgagctggtaccagcaggtgcccggcgccgcccccaaggtgctgatctacgagaacgacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32157 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcaacagcaacatcggcaacaactacgtgagctggtaccagcagctgcccggcaccgccaccaagctgctgatctacgagaacgacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32158 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcctgagcgccgcccccggccagcaggtgagcatcagctgcctgggcagaagcagcaacatcggcaccaactacgtgagctggtaccagcagttccccggcaccgcccccaagctgctgatctacgagaacaagaagagacccagcgagatccccgacagattcagcggcagcaagagcggcaccagcgccaccctgggcatcaccggcctgcagcccggcgacgaggccgactactactgcggcacctgggacagcagcctgagcgccggcggcgtgttcggcaccggcaccaaggtgaccgtgctg

SEQ ID NO: 32159 - RNA, 336 nt, synthetic construct
  misc_feature 1..336: note = derived and/or modified sequence opt4 from anti-HIV-1_LightChain
  source 1..336: mol_type = other RNA
cagagcgccctgacccagccccccagcgccagcggcagccccggccagagcgtgaccatcagctgcaccggcaccagcagcgacgtgggcgcctacaacagcgtgagctggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32160 - RNA, 333 nt, synthetic construct
  misc_feature 1..333: note = derived and/or modified sequence opt4 from anti-HIV-1_LightChain
  source 1..333: mol_type = other RNA
cagagcgccctgacccagccccccagcgccagcggcagccccggccagagcgtgaccatcagctgcagcggcggcagcagcaacatcggcaacaaccacgtgagctggtaccagcacctgcccggcagagccccccagctgctgatctacgacaccacccagagacccagcagaatccccgacagattcagcggcagcagaagcggcaccagcgccaccctggccatcaccggcctgcagaccggcgacgaggccgtgtactactgcggcacctgggacaacagcctgagcaccggcggcgtgttcggcaccggcaccaaggtgaccgtgctg

SEQ ID NO: 32161 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccatcagctgcagcggcggcaccagcaacatcggcaacgagtacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32162 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagagagtgaccgtgagctgcagcggcagcagcagcaacatcggcaacaactacgtgagctggtaccagcagctgcccggcgccgcccccaagctgctgatctacgacaccgacaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32163 - RNA, 333 nt, synthetic construct
  misc_feature 1..333: note = derived and/or modified sequence opt4 from anti-HIV-1_LightChain
  source 1..333: mol_type = other RNA
cagagcctgctgacccagccccccagcgtgagcgccgcccccggccagaaggtgaccatcagctgcagcggcggcaacagcgacatcggcaagaacttcgtgagctggtaccagcagagccccggcgccgcccccagactgctgatctacgagaacgacagaagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32164 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaacatcagctgcagcggcagcagcagcaacatcggcaagaactacgtgagctggtaccagcagatccccggcaccgcccccaaggtgctgatctacgagaacaacaagagacccagcggcatccccgacagattcagcggcagcaagagcggcaccagcgccaccctgggcatcgccggcctgcagaccggcgacgaggccgactactactgcgccacctgggacagcagcctgagcgccggcggcgtgttcggcaccggcaccaaggtgaccgtgctg

SEQ ID NO: 32165 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcaacagacacgtgagctggtaccagcagctgcccggcaccgtgcccaagctgctgatctacgagaccaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32166 - RNA, 336 nt, synthetic construct
  misc_feature 1..336: note = derived and/or modified sequence opt4 from anti-HIV-1_LightChain
  source 1..336: mol_type = other RNA
cagagcgtgctgacccagccccccagcgtgagcggcgcccccggccagagagtgaccatcagctgcaccggcagcagcagcaacatcggcgccggctacgacgtgcactggtaccagcagctgcccggcaccgcccccaagctgctgatcttcggccacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32167 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagctgcccagcgccagcggcctgcccggccagaccgtgaccatcagctgcagcggcagcaccagcagcatcggcagcaaccacgtgtactggtaccagcaggtggccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcgccacctgggacagcagcctgagcgccggcggcgtgttcggcaccggcaccaaggtgaccgtgctg

SEQ ID NO: 32168 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagacccccagcgccagcggcgcccccggccagggcgtgaccatcagctgcagcggcagcagcagcaacgtgggcagaaactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32169 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagttccccggcaccgcccccaagctgctgatcagcgacaacaacaagagacccagcggcatccccgacagattcagcgtgagcaagagcggcaccagcgccaccctgggcatcaccggcctgcaggccggcgacgaggccgactactactgcggcacctgggacagcagcctgagcgccggcggcgtgttcggcaccggcaccaaggtgaccgtgctg

SEQ ID NO: 32170 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcaacagcaacatcggcaacaactacgtgacctggtaccagcagttccccggcaccgcccccaaggtgctgatctacgacaacagcagaagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 32171 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcggcgcccccggccagagagtgaccatcagctgcagcggcagcagcagcaacatcggcaacaactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32172 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaccgtgaccatcagctgcagcggcagcaccagcaacatcggccagaacttcctgagctggttccagcacgtgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32173 - RNA, 333 nt, synthetic construct
  misc_feature 1..333: note = derived and/or modified sequence opt4 from anti-HIV-1_LightChain
  source 1..333: mol_type = other RNA
aacttcatgctgacccagccccccagcgccagcggcacccccggccagagagtgaccatcagctgcagcggcagcagcagcaacatcggcagcaagtacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32174 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagctgctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaacagcctgagcaccggcggcgtgttcggcaccggcaccaaggtgaccgtgctg

SEQ ID NO: 32175 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagatcatcatctacgacaacaacaagagacccagcggcatccccgacagattcagcggcagcaagagcggcaccagcgccaccctgggcatcaccggcctgcagaccggcgacgaggccgactactactgcggcacctggcacagcagcctgagcgccggcggcgtgttcggcaccggcaccaaggtgaccgtgctg

SEQ ID NO: 32176 - RNA, 333 nt, synthetic construct
  misc_feature 1..333: note = derived and/or modified sequence opt4 from anti-HIV-1_LightChain
  source 1..333: mol_type = other RNA
cagagcgtgctgacccagccccccagcgccagcgccacccccggccagagagtgaccatcagctgcagcggcagcagcagcaacatcggcagcaagcacgtgtactggtaccagaagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacagaagcctgagcgccggcggcgtgttcggcaccggcaccaaggtgaccgtgctg

SEQ ID NO: 32177 - RNA, 432 nt, synthetic construct
  misc_feature 1..432: note = derived and/or modified sequence opt4 from anti-HIV-1_HeavyChain
  source 1..432: mol_type = other RNA
caggcccagctggtggagagcggcggcggcgtggtgcagcccggcagaagcctgagactgagctgcgccgccagcggcttcaccttcagcagctacggcatccactgggtgagacaggcccccggcaagggcctggagtgggtggccgtgatgagcagcgacggcacctacaagtactacggcgacagcatgaagggcagattcaccatcagcagagacaacagcaagaacagcctgtacctgcagatgaacagcctgagagccgtggacaccgccgtgtactactgcgccaaggacctgggcgagggcgagaacgaggagtgggccaccgactactacgacttcagcatcggctaccccggccaggaccccagaggcgtggtgggcaccttcgacatctggggccagggcaccatggtgaccgtgagcagc

SEQ ID NO: 32178 - RNA, 426 nt, synthetic construct
  misc_feature 1..426: note = derived and/or modified sequence opt4 from anti-HIV-1_HeavyChain
  source 1..426: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagcgacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttctggggccagggcaccatggtgaccgtgagcagc

SEQ ID NO: 32179 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagagcggcagaagcctgagactgagctgcgccgccagcggcttcaccttcagcgcctacgccctgcactgggtgagacaggcccccggcaagggcctggagtgggtggccgtgatcagctacgacggcagagacaaggactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32180 - RNA, 432 nt, synthetic construct
  misc_feature 1..432: note = derived and/or modified sequence opt4 from anti-HIV-1_HeavyChain
  source 1..432: mol_type = other RNA
caggtgcagctggtgcagagcggcggcggcctggtgcagcccggcagaagcctgagactgagctgcgtggccagcggcttcagattcagcttccacggcatgcactgggtgagacaggcccccggcaagggcctggagtgggtggccgtggtgagcgacgacggcagcgaccagaagtacgtggacagcgtgaagggcagactgaccatcagcagagacaacagcaagaacaccgtgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32181 - RNA, 432 nt, synthetic construct
  misc_feature 1..432: note = derived and/or modified sequence opt4 from anti-HIV-1_HeavyChain
  source 1..432: mol_type = other RNA
gaggtgcacctggtggagagcggcggcggcgtggtgcagcccggcagaagcctgagactgagctgcgccgccagcggcttcaccttcaacagctacgccatgatctgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagaacgaggagtgggccagcgactactacgacttcggcagagactaccccggccaggaccccagaggcgtggtgggcaccttcgacatctggggccacggcaccatggtgaccgtgagcagc

SEQ ID NO: 32182 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgagacccggcggcagcctgagactgagctgcaccgccagcggcttccacttcaacaagtacggcatgaactgggtgagacaggcccccggcaagggcctggccctggtggccttcatccagagcggcgccagctacaactactacgccgacagcgtgaagggcagattcaccatcagcagagacaacagcaagaacaccctgtacctgcagatgaacagcctgagagccgaggacaccgccgtgtactactgcgccaaggacctgggcgacagcgagaacgaggagtgggccagcgactactacgacttcggcagagactaccccggccaggaccccagaggcgtggtgggcgccttcgacatctggggccacggcaccatggtgaccgtgagcagc

SEQ ID NO: 32183 - RNA, 432 nt, synthetic construct
  misc_feature 1..432: note = derived and/or modified sequence opt4 from anti-HIV-1_HeavyChain
  source 1..432: mol_type = other RNA
caggtgcacctggtggagagcggcggcggcgtggtgcagcccggcaagagcctgaccatctactgcgccgtgagcgagttcaccctgagcaactacgccatgcactgggtgagactgacccccggcaagggcctgcagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagagactaccccggccaggaccccagaggcgtggtgggcgtgttcgacatctggggccagggcaccatggtgaccgtgagcagc

SEQ ID NO: 32184 - RNA, 432 nt, synthetic construct
  misc_feature 1..432: note = derived and/or modified sequence opt4 from anti-HIV-1_HeavyChain
  source 1..432: mol_type = other RNA
gaggtgcagctgctggagagcggcggcggcgtggtgcagcccggcagaagcctgagactgagctgcgccgccagcggcttcaccttcagcacctacgccctgcactgggtgagacaggcccccggcaagggcctggagtgggtggccgtgatcagctacgacggcagcaccaagttctacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32185 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatcagatacgacggcagcaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagatcgaggagtggaccagcgactactacgacttcggcagagactaccccggccaggaccccagaggcgtgttcggcaccttcgacatctggggccacggcaccatggtgaccgtgagcagc

SEQ ID NO: 32186 - RNA, 432 nt, synthetic construct
  misc_feature 1..432: note = derived and/or modified sequence opt4 from anti-HIV-1_HeavyChain
  source 1..432: mol_type = other RNA
gaggtgcagctggtggagagcggcggcggcgtggtgaagcccggcggcagcctgagactgagctgcgtggtgagcggcttcaccttcagcaacgcctggatgagctgggtgagacaggcccccggcaagggcctggagtgggtggccgtgatcagcgacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32187 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcggcttcaccttcagcacctacggcatgcactgggtgagacaggcccccggcaagggcctggagtgggtggccttcatcagatacgacggcagaaacaagaactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcatcggctaccccggccaggaccccagaggcgtggtgggcatcttcgacatctggggccagggcaccatggtgaccgtgagcagc

SEQ ID NO: 32188 - RNA, 432 nt, synthetic construct
  misc_feature 1..432: note = derived and/or modified sequence opt4 from anti-HIV-1_HeavyChain
  source 1..432: mol_type = other RNA
caggtgcacctggtggagagcggcggcggcgtggtgcagcccggcggcagcctgagactgagctgcgccgccagcggcttcagcttcagcatctacggcatgcactgggtgagacaggcccccggcaagggcctggagtgggtgaccttcaccagatacgacggcagcaacaagtactacaccgacagcgtgaagggcagattcaccatcagcagagacaacagcaagaacaccctgtacctgcagatgaacagcctgagaaccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32189 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatcagatacgacggcagcaacaagtactacgccgaccccgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagagactaccccggccaggaccccagaggcgtggtgggcgtgttcgacatctggggccagggcaccatggtgaccgccagcagc

SEQ ID NO: 32190 - RNA, 432 nt, synthetic construct
  misc_feature 1..432: note = derived and/or modified sequence opt4 from anti-HIV-1_HeavyChain
  source 1..432: mol_type = other RNA
gagatgcagctggtggagagcggcggcggcctggtgcagcccggcggcagcctgagactgagctgcgccgccagcggcttcaccttcagcagctactggatgagctgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagaggcgtggtgggcaccttcgacatctggggccacggcaccatggtgaccgtgagcagc

SEQ ID NO: 32191 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagctgcgccatgcactgggtgagacaggcccccggcaagggcctggagtgggtggccgtgatcagctacgacggcaacaacaagcactacgccgacagcgtgaagggcagattcaccatcagcagagacaacagcaagaacaccctgtacctgcagatgaacagcctgagagccgaggacatggccgtgtactactgcgccaaggacctgggcgagagcgagaacgaggagtgggccagcgactactacgacttctggagagactaccccggccaggaccccagaggctgggtgggcaccttcgacatctggggccagggcaccatggtgaccgtgagcagc

SEQ ID NO: 32192 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcaactacggcatgcactgggtgagacaggcccccggcaagggcctggagtgggtgaccgtgatcagcagcgacggcagcaagaagtactacgccgacagcgtgaagggcagattcaccatcagcagagacaacagcaagaacaccctgtacctgcagatgaacggcctgagagccgacgacaccgccgtgtactactgcgccaaggacctgggcgacagcgagaacgaggagtgggccagcgactactacgacttcggcagagactaccccggccaggaccccagaggcgtggtgggcgccttcgacatctggggccacggcaccatggtgaccgtgagcagc

SEQ ID NO: 32193 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatcagatacgacggcagcaacaagtactacgccgacagcgtgaagggcagattcaccatcagcagagacaacagcaagaacaccctgtacctgcagatgaacagcctgagagccgtggacaccgccgtgtactactgcgccaaggacctgggcgagggcgagaacgaggagtgggccaccgactactacgacttcagcatcggctaccccggccaggaccccagaggcgtggtgggcgccttcgacatctggggccagggcaccatggtgaccgtgagcagc

SEQ ID NO: 32194 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagaaactacggcatgcactgggtgagacagagccccggcaagggcctggagtgggtggccgtgatcagctacgacggcaagatcatcaactacatcgacttcgtgaagggcagattcaccatcagcagagagaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagaggcgtggtgggcaccttcgacatctggggccacggcaccatggtgaccgtgagcagc

SEQ ID NO: 32195 - RNA, 432 nt, synthetic construct
  misc_feature 1..432: note = derived and/or modified sequence opt4 from anti-HIV-1_HeavyChain
  source 1..432: mol_type = other RNA
gaggtgcagctgctggagagcggcggcggcctggtgcagcccggcagaagcctgagactgagctgcgccgccagcggcttcaccttcagcagctacgtgatgcactgggtgagacaggcccccggcaagggcctggagtgggtggccgtgatcagctacgacggcagcaacaagcactacgccgacagcgtgaagggcagattcaccatcagcagagacaacagcaagaacaccctgtacctgcagatgaacagcctgagagccgaggacaccgccgtgtactacagagccaaggacctgggcgagagcgagaacgaggagtgggccagcgactactacgacttcggcagagactaccccggccaggaccccagaggcgtggtgggcgtgctgtacatctggggccagggcaccatggtgaccgtgagcagc

SEQ ID NO: 32196 - RNA, 432 nt, synthetic construct
  misc_feature 1..432: note = derived and/or modified sequence opt4 from anti-HIV-1_HeavyChain
  source 1..432: mol_type = other RNA
gaggtgcagctggtggagagcggcggcggcctggtgaagcccggcggcagcctgagactgagctgcgccgccagcggcttcaccttcagcacctacagcatgcactgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagaacgaggagtgggccagcgactactacgacttcggcagagactaccccggccaggaccccagaggcgtggtgggcaccttcgacatctggggccacggcaccatggtgaccgtgagcagc

SEQ ID NO: 32197 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggacagcggcggcggcgtggtgcagcccggcagaagcctgagactgttctgcgccgtgagcggcttcaccttcagcacctacaccatgcactgggtgagacaggcccccggcagaggcctggagtgggtggccgtgatcagctacgacggcagcaccaagtactacgccgacagcgtgcagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32198 - RNA, 426 nt, synthetic construct
  misc_feature 1..426: note = derived and/or modified sequence opt4 from anti-HIV-1_HeavyChain
  source 1..426: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagacccgaggacaccgccgtgtactactgcgccaaggacctgggcgagagcgagaacgaggagtgggccagcgactactacgacttcggcagagactaccccggccaggaccccagaggcgtggtgggcaccttcgacatctggggccacggcaccatggtgaccgtg

SEQ ID NO: 32199 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcatgttcagcagatacggcatgcactgggtgagacaggcccccggcaagggcctggagtgggtggccgtgatcagccacgacggcagcaacaagtactacgccgacagcgtgaagggcagattcatcatcagcagagacaacagcaagaacaccctgtacctgcagatgaacagcctgagagccgacgacaccgccgtgtactactgcgccaaggacctgggcgagagcgagaacgaggagtgggccagcgactactacgacttctggatcggctaccccggccaggaccccagaggcgtggtgggcgccttcgacatctggggccagggcaccatggtgaccgtgagcagc

SEQ ID NO: 32200 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcgccttcaccttcagcagctacggcatgcactgggtgagacaggcccccggcaagggcctggagtgggtggccttcatcagatacgacggcagcaacaagtactacgccgacagcgtgaagggcagattcaccatcagcagagacaacagcaagaacaccctgttcctgcagatgaacagcctgagagccgaggacatggccgtgtactactgcgccaaggacctgggcgagagcgagaacgaggagtgggccagcgactactacgacttctggagagactaccccggccaggaccccagaggctgggtgggcaccttcgacatctggggccagggcaccatggtgaccgtgagcagc

SEQ ID NO: 32201 - RNA, 426 nt, synthetic construct
  misc_feature 1..426: note = derived and/or modified sequence opt4 from anti-HIV-1_HeavyChain
  source 1..426: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagctacgacggcagcaacaagtactacgtggacagcgtgaagggcagattcaccatcagcagagacaacagcaagaacaccctgtacctgcagatgaacagcctgagagccgaggacaccgccgtgtacgccaaggacctgggcgagagcgagaacgaggagtgggccagcgactactacgacttcggcagcgactaccccggccaggaccccagaggcgtggtgggcaccttcgacatctggagccagggcaccatggtgaccgtgagcagc

SEQ ID NO: 32202 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcggcttcaccttcagcacctacggcatgcactgggtgagacaggcccccggcaagggcctggactgggtggccttcatcagatacgacggcagccacaagtactacgccgacagcgtgaagggcagattcaccatcagcagagagaacagcaagaacaccctgtacctgcagatgaacagcctgagacccgaggacaccgccgtgtactactgcgccaaggacctgggcgagagcgagaacgaggagtgggccagcgactactacgacttcggcagagactaccccggccaggaccccagaggcgtggtgggcaccttcgacatctggggccacggcaccatggtgaccgtgagcagc

SEQ ID NO: 32203 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcggcgactactacgccgacagcgtgaagggcagattcaccatcagcagagacaacagcaagagcaccctgtacctgcagatgaacagcctgagacccgaggacaccgccgtgtactactgcgccaaggacctgggcgagagcgagaacgaggagtgggccagcgactactacgacttcggcagagactaccccggccaggaccccagaggcgtggtgggcaccttcgacatctggggccacggcaccatggtgaccgtgagcagc

SEQ ID NO: 32204 - RNA, 432 nt, synthetic construct
  misc_feature 1..432: note = derived and/or modified sequence opt4 from anti-HIV-1_HeavyChain
  source 1..432: mol_type = other RNA
caggtgcacctggtggagagcggcggcggcgtggtgcagcccggcggcagcctgagactgagctgcgccgccagcggcttcaccttcagcacctacggcatgcagtgggtgagacaggcccccggcaagggcctggagtgggtggccttcatcaagaacgacggcaccaacgagttctacggcgacagcgtgaagggcagattcaccatcagcagagacaacagcaagaacaccgtgagcctgcacatggacagcctgagacccgaggacaccgccctgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32205 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgtggccagcggcttcaccttcagcagctacggcatgcactgggtgagacaggcccccggcaagggcctggagtgggtggccttcatcagatacgacggcagaaacaagtactacgccgacagcgtgaagggcagattcaccatcagcagagacaagagcaagaacaccctgtgcctgcagatgaacagcctgagagtggaggacaccgccgtgtactactgcgccaaggacctgggcgacagcgagaacgaggagtgggccagcgactactacgacttcggcagagactaccccggccaggaccccagaggcgtggtgggcgccttcgacatctggggccacggcaccatggtgaccgtgagcagc

SEQ ID NO: 32206 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgacggcagcaacaagtactacagagacagcgtgaagggcagattcaccatcagcagagacaacagcaagaacaccgtgtacctgcagatgaacagcctgagagccgaggacaccgccgtgtactactgcgccaaggacctgggcgagagcgagagcgaggagtgggccagcgactactacgacttcggcagagactaccccggccaggaccccagaggcgtggtgggcgccctggacatctggggccagggcatcatggtgaccgtgagcagc

SEQ ID NO: 32207 - RNA, 432 nt, synthetic construct
  misc_feature 1..432: note = derived and/or modified sequence opt4 from anti-HIV-1_HeavyChain
  source 1..432: mol_type = other RNA
gaggtgcagctggtggagagcggcggcggcatggtgcagcccggcagacccctgagactgagctgcgccgccagcggcttcatcttcagcggcttcggcctgcactgggtgagacaggcccccggcaagggcctggagtgggtggccagcatcagctacgacggcggcaacaagtactacgccgacagcgtgagaggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32208 - RNA, 432 nt, synthetic construct
  misc_feature 1..432: note = derived and/or modified sequence opt4 from anti-HIV-1_HeavyChain
  source 1..432: mol_type = other RNA
gaggtgcagctggtggagagcggcggcggcgtggtgagacccggcggcagcctgagactgagctgcgccgccagcggcttcaccttcaacgactacggcatggcctgggtgagacaggcccccggcaagggcctggagtgggtggccgacatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagagactaccccggccaggaccccagaggcgtggtgggcgccttcgacatctggggccagggcaccatggtgaccgtgagcagc

SEQ ID NO: 32209 - RNA, 429 nt, synthetic construct
  misc_feature 1..429: note = derived and/or modified sequence opt4 from anti-HIV-1_HeavyChain
  source 1..429: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtggtgagctacgacgagagcaagtactacgccgacagcgtgaagggcagattcaccatcagcagagacaacagcaagaacaccctgtacctgcagatgaacagcctgagagccgaggacatggccgtgtactactgcgccaaggacctgggcgagagcgagaacgaggagtgggccagcgactactacgagttctggagagactaccccggccaggaccccagaggctgggtgggcaccttcgacatctggggccagggcaccatggtgaccgtgagcagc

SEQ ID NO: 32210 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagcccggcagaggcgtggtgcaccccggcggcagcctgagactgagctgcgtgaccagcggcttcaccttcgagaacttccccatgcactgggtgagacaggcccccggcaagggcctggagtgggtggccctgatcagctacgacggcagcgacaagtactacagcgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagaggcgtggtgggcaccttcgacatctggggccacggcaccatggtgaccgtgagcagc

SEQ ID NO: 32211 - RNA, 432 nt, synthetic construct
  misc_feature 1..432: note = derived and/or modified sequence opt4 from anti-HIV-1_HeavyChain
  source 1..432: mol_type = other RNA
caggcccagctggtggagagcggcggcggcgtggtgcagcccggcagaagcctgagactgagctgcgccgccagcggcttcagcttcgccacccacgccatgcactgggtgagaagaagccccggcaagggcctggagtgggtggccaccatcagctacggcggcaagaacgagtactacgccgacagcgtgaagggcagattcaccatcagcagagagaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagaggcgtggtgggcaccttcgacatctggggccacggcaccatggtgaccgtgagcagc

SEQ ID NO: 32212 - RNA, 432 nt, synthetic construct
  misc_feature 1..432: note = derived and/or modified sequence opt4 from anti-HIV-1_HeavyChain
  source 1..432: mol_type = other RNA
gccgtgcagctggtggagagcggcggcggcctggtgaagcccggcggcagcctgagactgagctgcgccgccagcggcttcaccttcttcaacacctggatgagctgggtgagacagagccccggcaagggcctggagtgggtggccgacatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagagactaccccggccaggaccccagaggcgtggtgggcgtgttcgacatctggggccagggcaccatggtgaccgtgagcagc

SEQ ID NO: 32213 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagagccgtggtgggcgccttcgacatctggggccagggcaccatggtgaccgtgagcagc

SEQ ID NO: 32214 - RNA, 432 nt, synthetic construct
  misc_feature 1..432: note = derived and/or modified sequence opt4 from anti-HIV-1_HeavyChain
  source 1..432: mol_type = other RNA
caggtgagactggtggagagcggcggcagagtggtgcagcccggcggcagcctgagactgagctgcgtggccagcggcttcaccttcagcagctacggcatccactgggtgagacaggcccccggcaagggcctggagtgggtgaccttcatctggcacgacggcagagacacctactacgccgacgccgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttctggaccggctaccccggccaggaccccagagccgtggtgggcgccttcgacatctggggccagggcaccatggtgaccgtgagcagc

SEQ ID NO: 32215 - RNA, 432 nt, synthetic construct
  misc_feature 1..432: note = derived and/or modified sequence opt4 from anti-HIV-1_HeavyChain
  source 1..432: mol_type = other RNA
caggtgcacctggtggagagcggcggcggcgtggtgcagcccggcagaagcctgagaatctactgcgccgtgagcgagttcaccttcagaaactacgccatgcactgggtgagactggcccccggcaagggcctgcagtgggtggccgtgatcagctacgacggcagcaacaagtactacggcgacagcgtgaagggcagattcaccatcagcagagacaacagcaagaacaccctgtacctgcagatggacagcctgagagccgaggacaccgccgtgtactactgcgccaaggacctgggcgagagcgagaacgaggagtgggccagcgactactacgacttcggcagagactaccccggccaggaccccagaggcgtggtgggcaccttcgacatctggggccacggcaccatggtgaccgtgagcagc

SEQ ID NO: 32216 - RNA, 432 nt, synthetic construct
  misc_feature 1..432: note = derived and/or modified sequence opt4 from anti-HIV-1_HeavyChain
  source 1..432: mol_type = other RNA
gaggtgcagctggtggagagcggcggcggcctggtgaagcccggcggcagcctgagactgagctgcgccgccagcggcttcaccttcagcgacgcctggatgagctgggtgagacaggcccccggcaagggcatggagtgggtggccgtgatcagctacgacggcagcaacaagtactacgccgacagcgtgaagggcagattcaccatcagcagagacaacagcaagaacaccctgtacctgcagatgaacagcctgagagccgtggacaccgccgtgtactactgcgccaaggacctgggcgagggcgagaacgaggagtgggccaccgactactacgacttcagcatcggctaccccggccaggaccccagaggcgtggtgggcgccttcgacatctggggccagggcaccatggtgaccgtgagcagc

SEQ ID NO: 32217 - RNA, 432 nt, synthetic construct
  misc_feature 1..432: note = derived and/or modified sequence opt4 from anti-HIV-1_HeavyChain
  source 1..432: mol_type = other RNA
gaggtgcaggtggtggagagcggcggcggcctggtgaagcccggcggcagcctgagactgagctgcgaggccagcggcttcaccttcagcaacgcctggatgagctgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagaacgaggagtgggccagcgactactacgacttcggcagagactaccccggccaggaccccagaggcgtggtgggcaccttcgacatctggggccacggcaccatggtgaccgtgagcagc

SEQ ID NO: 32218 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcggcagcctgagactgagctgcgccgccagcggcttcaccttcagcagctacggcatccactgggtgagacaggcccccggcaagggcctggagtgggtggccttcatcagaagcgacgccaccaacaagtactacgccgacagcgtgaagggcagattcaccatcagcagagagaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagaggcgtggtgggcaccttcgacatctggggccacggcaccatggtgaccgtgagcagc

SEQ ID NO: 32219 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagagccgaggacaccgccgtgtactactgcgccaaggacctgggcgagagcgagaacgaggagtgggccagcgactactacgacttcggcagcgactaccccggccaggaccccagaggcgtggtgggcaccttcgacatctggggccacggcaccatggtgaccgtgagcagc

SEQ ID NO: 32220 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcaactacgccatggactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttctggaccggctaccccggccaggaccccagagccgtggtgggcgccttcgacatctggggccagggcaccatggtgaccgtgagcagc

SEQ ID NO: 32221 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtggtgagctacgacgagagcaacaagtactacgccggcagcgtgaagggcagattcaccatcagcagagacaacagcaagaacaccctgtacctgcagatgaacagcctgagaaccgaggacatggccgtgtactactgcgccaaggacctgggcgagagcgagaacgaggagtgggccagcgactactacgacttcggcagagagtaccccggccaggaccccagaggctgggtgggcaccttcgacatctggggccagggcaccatggtgaccgtgagcagc

SEQ ID NO: 32222 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgacggcagcaacaagtactacgtggacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcatcggctaccccggccaggaccccagaggcgtggtgggcatcttcgacatctggggccagggcaccatggtgaccgtgagcagc

SEQ ID NO: 32223 - RNA, 432 nt, synthetic construct
  misc_feature 1..432: note = derived and/or modified sequence opt4 from anti-HIV-1_HeavyChain
  source 1..432: mol_type = other RNA
caggtgcagctggtggagagcggcggcggcgtggtgcagcccggcagaagcctgagactgagctgcgccgccagcggcttcaccttcagcaccagcggcatgcactgggtgagacaggcccccggcaagggcatggagtgggtggccgtgatcagctacgacggcagcaacaagtactacgccgacagcgtgaagggcagattcaccatcagcagagacaacagcaagaacaccctgtacctgcagatgaacagcctgagagccgtggacaccgccgtgtactactgcgccaaggacctgggcgagggcgagaacgaggagtgggccaccgactactacgacttcagcatcggctaccccggccaggaccccagaggcgtggtgggcgccttcgacatctggggccagggcaccatggtgaccgtgagcagc

SEQ ID NO: 32224 - RNA, 363 nt, synthetic construct
  misc_feature 1..363: note = derived and/or modified sequence opt4 from anti-HIV_C38-VRC18.02_HeavyChain
  source 1..363: mol_type = other RNA
caggtgagactggtgcagagcggcaaccaggtgagaaagcccggcgccagcgtgagaatcagctgcgaggccagcggctacaagttcatcgaccacttcatccactgggtgagacaggtgcccggccacggcctggagtggctgggctggatcaaccccagaggcggcggcgtgaactacagcagaagcttccagggcaagctgagcatgaccatgaccagagacaacttcgaggagaccgcctacctggacctgagcaagctgaaccccggcgacaccgccgtgtacttctgcgccagaggcttcgccggctacgagtggagcttcatctggggccagggcaccctggtgatcgtgagcagc

SEQ ID NO: 32225 - RNA, 396 nt, synthetic construct
  misc_feature 1..396: note = derived and/or modified sequence opt4 from anti-HIV_44-VRC13.02_HeavyChain
  source 1..396: mol_type = other RNA
caggtgcagctggtgcagagcggcaccgccctgaagagccccggcagcagcgccaagctgagctgcaccgtgctgggcgacgagttcggcacctacttcatcagctggatcagacaggcccccggccagggcctggagtgggtgggcggcatcgtgccccacagccagctgcagagcagcgcccagaagttccacggcagaatcatcatcagcgccggcgccggcgtgaccccccccgtggtgagcctgcagctgaccaacctgaccttcgaggacaccggcacctacttctgcgccagagagagaggcagacacagagaccccaagaccggcgacgccctgagaggcagatacttcgacttctggggcagaggcaccggcctgagagtgagcacc

SEQ ID NO: 32226 - RNA, 321 nt, synthetic construct
  misc_feature 1..321: note = derived and/or modified sequence opt4 from anti-HIV-1_LightChain
  source 1..321: mol_type = other RNA
gacatcaagctgacccagagccccgccttcctgagcgccagcgtgggcgagagagtgaccttcacctgcagagccagccaggacatcagccacgacctggtgtggttccagcagaaggccggcagagcccccagcctgctgatgttctacggcagcaccctggagagaggcgtgccccccagattcagcggcagaagaagcggcaccgagttcaccgtgaccatcgacagcctgcagcccgaggacgtgggcacctactactgccagcagctgagcgccttccccctgaccttcggcggcggcaccaccgtggacatcaag

SEQ ID NO: 32227 - RNA, 321 nt, synthetic construct
  misc_feature 1..321: note = derived and/or modified sequence opt4 from anti-HIV-1_LightChain
  source 1..321: mol_type = other RNA
gacatcaagatgacccagagccccgccttcctgagcgccagcgtgggcgagagagtgaccttcacctgcagagccagccaggacatcagccacgacgtggtgtggttccagcagaagagcggcagcgcccccaagctgctgatgttctacggcagcaccctggagagaggcgtgccccccagattcagcggcagaagaagcggcaccgagttcaccgtgaccatcgacggcctgcagcccgaggacgtgggcacctactactgccagcagctgagcgccttccccctgaccttcggcggcggcaccaccgtggacatcaag

SEQ ID NO: 32228 - RNA, 321 nt, synthetic construct
  misc_feature 1..321: note = derived and/or modified sequence opt4 from anti-HIV-1_LightChain
  source 1..321: mol_type = other RNA
gacatcaagctgacccagagccccgccttcctgagcgccagcgtgggcgagagagtgaccttcacctgcagagccagccaggacatcagacacgagctggtgtggtaccagcagaagcccggcagaggccccaagctgctgatctactacggcagcaccctggagggcggcgtgcccagcagattcagcggcagaagaagcggcaccgagttcaccgtgaccatcagcagcctgcagcccgaggacgtgggcacctactactgccagcagctgaacagcttccccctgaccttcggcggcggcaccaccgtggacatcaga

SEQ ID NO: 32229 - RNA, 321 nt, synthetic construct
  misc_feature 1..321: note = derived and/or modified sequence opt4 from anti-HIV-1_LightChain
  source 1..321: mol_type = other RNA
gacatccagctgacccagagccccagcttcctgagcgccagcgtgggcgacagagtgagcatcacctgcagagccagccagggcatcaagcacgagctggcctggtaccagcagaagcccggcagagcccccagcctgctgatctactacgccagcaccctggccagaggcgtgcccagcagattcagcgccagctggagcggcaccctgttcaccctgaccatcaacggcctgcagcccgaggacttcgccacctacttctgccagcagatgaacagcctgcccctgaccttcggcggcggcaccaagatggacgtgaga

SEQ ID NO: 32230 - RNA, 321 nt, synthetic construct
  misc_feature 1..321: note = derived and/or modified sequence opt4 from anti-HIV-1_LightChain
  source 1..321: mol_type = other RNA
gacatccagctgacccagagccccagcttcctgagcgccagcgtgggcgacaaggtgaccatcacctgcagagccagccacggcgtgagaaacgagctggcctggtaccagcagaagcccggcaaggcccccaacctgctgatctactacgccagcaccctgcagagcggcgtgcccagcagattcagcgccaccggcagcggcacccacttcaccctgaccgtgagcagcctgcagcccgaggacttcgccacctacttctgccagcacatgagcagctaccccctgaccttcggcggcggcaccaaggtggagatcaag

SEQ ID NO: 32231 - RNA, 321 nt, synthetic construct
  misc_feature 1..321: note = derived and/or modified sequence opt4 from anti-HIV-1_LightChain
  source 1..321: mol_type = other RNA
gacatccagctgacccagagccccagcttcctgagcgccagcgtgggcgacaaggtgaccttcacctgcagagccagccagggcgtgagaaacgagctggcctggtaccagcagaagcccggcaaggcccccaacctgctgatctactacgccagcaccctgcagagcggcgtgcccagcagattcagcgccaccggcagcggcacccacttcagcctgaccgtgagcagcctgcagcccgaggacttcgccacctacttctgccagcacatgagcagctaccccctgaccttcggcggcggcaccaaggtggagatcaag

SEQ ID NO: 32232 - RNA, 321 nt, synthetic construct
  misc_feature 1..321: note = derived and/or modified sequence opt4 from anti-HIV-1_LightChain
  source 1..321: mol_type = other RNA
gacatccagctgacccagagccccagcttcctgagcgccagcgtgggcgacaaggtgaccatcacctgcagagccagccagggcgtgagaaacgagctggcctggtaccagcagaagcccggcaaggcccccaacctgctgatctactacgccagcaccctgcagagcggcgtgcccagcagattcagcgccaccggcagcggcacccacttcaccctgaccgtgagcagcctgcagcccgaggacttcgccacctacttctgccagcacatgagcagctaccccctgaccttcggcggcggcaccaaggtggagatcaag

SEQ ID NO: 32233 - RNA, 366 nt, synthetic construct
  misc_feature 1..366: note = derived and/or modified sequence opt4 from anti-HIV-1_HeavyChain
  source 1..366: mol_type = other RNA
agccagtacctggcccagcccggcgccgaggtggccaagcccggcgccagcgtgaaggtgagctgcaaggtgcacggcgacaacttcagaggccactacctgcactgggtgagacaggcccccggccagggcctgcagtggatcggcggcatcaaccccttcagcggcgaggccgcctacggcaagagattcgagggcagactgagactgaccagagacaccagcgtgaacaccgcctacatggagctggccaagctgacccccgacgacaccgccgtgtacttctgcgccagagacaagacctacaacgacgagttcaccgccatggacatctggggccacggcaccaccgtgatcgtgagcagc

SEQ ID NO: 32234 - RNA, 366 nt, synthetic construct
  misc_feature 1..366: note = derived and/or modified sequence opt4 from anti-HIV-1_HeavyChain
  source 1..366: mol_type = other RNA
agccagtacctggcccagcccggcgccgaggtggccaagccctgggccagcgtgaaggtgagctgcagagtgcacggcgacaacttcagaggcttctacctgcactgggtgagacaggcccccggccagggcctggagtggatcggcggcatcaaccccttcagcggcgaggccgcctacggcagaagattcgagggcagactgagactgaccagagacaccagcatcaacaccgcctacatggaggtgaccaagctgaccagcgacgacaccgccgtgtacttctgcgccagagacaagacctacaacgacgagttcaccgccatggacatctggggccagggcaccaccgtgatcgtgagcagc

SEQ ID NO: 32235 - RNA, 366 nt, synthetic construct
  misc_feature 1..366: note = derived and/or modified sequence opt4 from anti-HIV-1_HeavyChain
  source 1..366: mol_type = other RNA
agccagtacctggcccagagcggcagcgaggtgaagaagcccggcgccagcgtgaaggtgagctgcagactgcacggcgacaagttcggcgcccactacatccactgggtgagacaggcccccggccagggcctggagtggctgggcttcttccaccccggcaccggcgacgccgtgagcgcccagaagttccagggcagaatcagcctgaccagagacaccagcatcagcaccggctacctggaggtgagaagactgagcagcgacgacaccgccgtgtactactgcgccagagacaagacctacagcgacgaggccaccggcatggacatctggggccagggcaccaccgtgatcgtgagcagc

SEQ ID NO: 32236 - RNA, 366 nt, synthetic construct
  misc_feature 1..366: note = derived and/or modified sequence opt4 from anti-HIV-1_HeavyChain
  source 1..366: mol_type = other RNA
agcctggagctggtgcagagcggcaccgaggtgaagaagcccggcgccagcgtgaaggtgagctgcaagctgttcggcgacaccatcaccagcggccccatccactgggtgagacaggcccccggccagggcctggagtggatgggctggaccaacccccacagcggcgacaccgccaccgcccccaagttccagggcagagtgtacatgaccaacgacaagaagatcaacaccgccttcctggacgtgaccagactggccagcgacgacaccgccatctacttctgcgccagagacatgtactacagcaacgaggccgtgggcatggacgtgtggggccagggcaccaccgtgagcgtgagcagc

SEQ ID NO: 32237 - RNA, 366 nt, synthetic construct
  misc_feature 1..366: note = derived and/or modified sequence opt4 from anti-HIV-1_HeavyChain
  source 1..366: mol_type = other RNA
caggaggtgctggtgcagagcggcgccgaggtgaagaagcccggcgccagcgtgaaggtgagctgcagagccttcggctacaccttcaccgcccacgccctgcactgggtgagacaggcccccggccagggcctggagtggctgggctggatcaacccccacagcggcgacaccaccaccagccagaagttccagggcagagtgtacatgaccagagacaagagcatcaacaccgcctacctggaggtgaccagactgaccagcgacgacaccgccatcttctactgcgccagagacaagtactacggcgacgaggccgtgggcatggacgtgtggggccagggcaccagcgtgaccgtgagcagc

SEQ ID NO: 32238 - RNA, 366 nt, synthetic construct
  misc_feature 1..366: note = derived and/or modified sequence opt4 from anti-HIV-1_HeavyChain
  source 1..366: mol_type = other RNA
caggaggtgctggtgcagagcggcgccgaggtgaagaagcccggcgccagcgtgaaggtgagctgcagagccttcggctacaccttcaccggcaacgccctgcactgggtgagacaggcccccggccagggcctggagtggctgggctggatcaacccccacagcggcgacaccaccaccagccagaagttccagggcagagtgtacatgaccagagacaaggccatcaacaccgcctacctggacgtgaccagactgaccagcgacgacaccgccatctactactgcgccagagacaagtactacggcaacgaggccgtgggcatggacgtgtggggccagggcaccagcgtgaccgtgagcagc

SEQ ID NO: 32239 - RNA, 366 nt, synthetic construct
  misc_feature 1..366: note = derived and/or modified sequence opt4 from anti-HIV-1_HeavyChain
  source 1..366: mol_type = other RNA
caggaggtgctggtgcagagcggcgccgaggtgaagaagcccggcgccagcgtgaaggtgagctgcagagccttcggctacaccttcaccggcaacgccctgcactgggtgagacaggcccccggccagggcctggagtggctgggctggatcaacccccacagcggcgacaccaccaccagccagaagttccagggcagagtgtacatgaccagagacaagagcatcaacaccgccttcctggacgtgaccagactgaccagcgacgacaccggcatctactactgcgccagagacaagtactacggcaacgaggccgtgggcatggacgtgtggggccagggcaccagcgtgaccgtgagcagc

SEQ ID NO: 32240 - RNA, 303 nt, synthetic construct
  misc_feature 1..303: note = derived and/or modified sequence opt4 from anti-HIV_45_LightChain
  source 1..303: mol_type = other RNA
agcctgacccagagccccggcaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggccccgactacaacctgaccatcagcaacctggagagcggcgacttcggcgtgtactactgccagcagtacgagttcttcggccagggcaccaaggtgcaggtggacatcaag

SEQ ID NO: 32241 - RNA, 303 nt, synthetic construct
  misc_feature 1..303: note = derived and/or modified sequence opt4 from anti-HIV_45_LightChain
  source 1..303: mol_type = other RNA
gtgctgacccagagccccggcaccctgagcctgagccccggcgagaccgccaccatcagctgcagaaccagccagtacggcagcctggcctggtaccagcagagacccggccaggcccccagactggtgatctacagcggcagcaccagagccgccggcatccccgacagattcagcggcagcagaagcggccccgactacaccctgaccatcagcaacctggagagcggcgacttcggcgtgtactactgccagcagtacgagttcttcggccagggcaccaaggtgcagcaggacaacaag

SEQ ID NO: 32242 - RNA, 303 nt, synthetic construct
  misc_feature 1..303: note = derived and/or modified sequence opt4 from anti-HIV_45_LightChain
  source 1..303: mol_type = other RNA
gtgctgacccagagccccggcaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggccccgactacaacctgaccatcagcaacctggagagcggcgacttcggcgtgtactactgccagcagtacgagttcttcggccagggcaccaaggtgcaggtggacatcaag

SEQ ID NO: 32243 - RNA, 363 nt, synthetic construct
  misc_feature 1..363: note = derived and/or modified sequence opt4 from anti-HIV_45_HeavyChain
  source 1..363: mol_type = other RNA
caggtgagactgagccagagcggcggccagatgaagaagcccggcgagagcatgagaatcagctgcagagccagcggctacgagttcatcgactgcaccctgaactggatcagactggcccccggcagaagacccgagtggatgggctggctgaagcccagaggcggcgccgtgaactacgccagagtgttccagggcagagtgaccatgaccagagacgtgtacagcgacaccgccttcctggagctgagaagcctgaccgccgacgacaccgccgtgtacttctgcaccagaggcaagaccgtggactacaactgggacttcgagcacgtgggccccggcacccccgtgaccgtgagcagc

SEQ ID NO: 32244 - RNA, 363 nt, synthetic construct
  misc_feature 1..363: note = derived and/or modified sequence opt4 from anti-HIV_45_HeavyChain
  source 1..363: mol_type = other RNA
caggtgagactgagccagagcggcggccagatgaagaagcccggcgagagcatgagaatcagctgccaggccagcggctacgagttcatcgactgcaccctgaactgggtgagactggcccccggcagaagacccgagtggatgggctggctgaagcccagaggcggcgccgtgaactacgccagaatcttccagggcagagtgaccatgaccagagacgtgtacagcgacaccgccttcctggagctgagaagcctgaccgccgacgacaccgccgtgtacttctgcaccagaggcaagaactgcgactacaactgggacttcgagcacgtgggccccggctaccccgtgaccgtgagcccc

SEQ ID NO: 32245 - RNA, 375 nt, synthetic construct
  misc_feature 1..375: note = derived and/or modified sequence opt4 from anti-HIV_45_HeavyChain
  source 1..375: mol_type = other RNA
caggtgagactgagccagagcggcggccagatgaagaagcccggcgacagcatgagaatcagctgcagagccagcggctacgagttcatcaactgccccatcaactggatcagactggcccccggcaagagacccgagtggatgggctggatgaagcccagaggcggcgccgtgagctacgccagacagctgcagggcagagtgaccatgaccagagacatgtacagcgagaccgccttcctggagctgagaagcctgaccagcgacgacaccgccgtgtacttctgcaccagaggcaagtactgcaccgccagagactactacaactgggacttcgagcactggggccagggcacccccgtgaccgtgagcagc

SEQ ID NO: 32246 - RNA, 435 nt, synthetic construct
  misc_feature 1..435: note = derived and/or modified sequence opt4 from anti-HIV_cap256-206-252885_VR-Chain
  source 1..435: mol_type = other RNA
caggagcagctggtggagagcggcggcggcgtggtgccccccggcagcagcctgaccctgagctgcgtggccagcagattcaccttcagcgccttcggcatgcactgggtgagacaggcccccggcaagggcctggagtgggtggccggcgtgagcttcgtgggcatcaagaagtactacgccgacagcgtgaagggcagattcaccatcagcagagacaacagcaagaacaccctgttcctgcagatgaacggcctgagaggcgaggacaccggcctgtactactgcgtgaaggacatgagatacctggagtgcgaggagtgggccagcgactactacgacttcggcaagcccaaccagccctgcctggacagaagaggcgtgagcggcatcagcgccttctggggccagggcaccaccgtgaccgtgagcagc

SEQ ID NO: 32247 - RNA, 438 nt, synthetic construct
  misc_feature 1..438: note = derived and/or modified sequence opt4 from anti-HIV_cap256-206-249183_VR-Chain
  source 1..438: mol_type = other RNA
caggtgctgctggtggagagcggcggcggcgtggtggagcccggcaccagcctgaccctgagctgcgccgccagcagattcaccttcagcaacttcggcatgcactgggtgagacagacccccggcggcggcctggagtgggtggccagcatcagcaacgagggcaacaagaagtaccacgccgagagcgtgtggggcagattcatcatcagcagagacaacagcaagaacaccgtgttcctgcacatgagcagcctgagacccgacgacagcgccctgtacttctgcgtgagagacagacaggaggacgactgcgaggtgtggtggagcgactacgaggccttcggcagagagatcccctgcagacagtacagaggccagggcctggccggcatcttcgacatctggggcagaggcaccatggtgaccgtgagcagc

SEQ ID NO: 32248 - RNA, 438 nt, synthetic construct
  misc_feature 1..438: note = derived and/or modified sequence opt4 from anti-HIV_cap256-206-220956_VR-Chain
  source 1..438: mol_type = other RNA
cagatgatgctggtggagagcggcggcgacgtggtggagcccggcagaagcctgaccctgagctgcgccaccagccagttcaccttcagcaactacggcatgcactgggtgagacaggcccccggcagaggcctggagtgggtggccagcatcagcaacgagggcaacaagaagtaccacgccgagagcgtgtggggcagactgatcatcagcagagacaacagcaagaacaccctgttcctgcacatgagcagcctgagagccgacgacagcgccctgtacttctgcgtgagagacagacaggaggacgagtgcgaggagtggtggagcaactactacgccttcggcagaggcggcccctgcagaaagtacagaggccagggcctggccggcatcttcgacgtgtggggcagaggcaccatggtgaccgtgagcagc

SEQ ID NO: 32249 - RNA, 432 nt, synthetic construct
  misc_feature 1..432: note = derived and/or modified sequence opt4 from anti-HIV_cap256-206-220629_VR-Chain
  source 1..432: mol_type = other RNA
caggagcagctggtggagagcggcggcggcgtggtgccccccggcaagagcctgaagctgagctgcgtggccagcagattcagcttcggcgccttcggcatgcactgggtgagacaggcccccggcaagggcctggagtgggtggccggcatcagcttcgccggcatcaagaagtactacggcgacagcgtgaagggcagattctacatcagcagagacaacagccagaacaccctgttcctggagatgaacggcctgagaggcgacgacaccgccagatactactgcgtgaaggacctgagagagctggagtgcgaggagtgggccagcgactactacgacttcggcaagccccagccctgcctggacagcagaggcgtgagcggcatcagcgccatgtggggccccggcaccatggtgaccgtgagcagc

SEQ ID NO: 32250 - RNA, 381 nt, synthetic construct
  misc_feature 1..381: note = derived and/or modified sequence opt4 from anti-HIV_cap256-206-200599_VR-Chain
  source 1..381: mol_type = other RNA
caggagaagctggtggagagcggcggcggcgccgtgcagcccggcggcagcctgagactgagctgcgtggccagcggcttcaccttcaacggcttcggcatgcactgggtgagacaggcccccggcaagggcctggagtgggtggccaccatcagcttcagcggcgtgtacatcagcagagagaacagcaagaacaccctgtacctgcagatgaacggcctgagaggcgaggacaccgccctgtactactgcgccaaggacctgagatacctggagtgcggcgagtggagcacctactacccccagccctgcctggacaccagaggcgtgagcggcatcagcaacgtgtggggccccggcaccagagtgaccgtgagcagc

SEQ ID NO: 32251 - RNA, 432 nt, synthetic construct
  misc_feature 1..432: note = derived and/or modified sequence opt4 from anti-HIV_cap256-206-186347_VR-Chain
  source 1..432: mol_type = other RNA
caggagctgctggtggagagcggcggcggcgtggtgccccccggcaagagcctgaccatcagctgcgtggccagcagattcaccttcagcgccttcggcatgcactgggtgagacaggcccccggcaagggcctgcagtgggtggccagcatcagcttcgccggcaccaagaagtactacgccgacttcgtgaagggcagattcaccatcagcagagacaacagcaagaacaccatcttcctgcagatgaacggcctgagaggcgaggacaccgccctgtaccactgcgtgaaggacatgagacagctggagtgcgaggagtggaccagcgactactacgacttcggcagaccccagccctgcatcgacagaagaggcgtgagcggcatcagcgccatgtggggccccggcaccatggtgaccgtgagcagc

SEQ ID NO: 32252 - RNA, 438 nt, synthetic construct
  misc_feature 1..438: note = derived and/or modified sequence opt4 from anti-HIV_cap256-206-186226_VR-Chain
  source 1..438: mol_type = other RNA
cagatgctgctggtggagagcggcggcggcgtggtggagcccggcagaagcctgaccctgagctgcgccaccagccagttcaccttcagcaactacggcatgcactgggtgagacagacccccggcaccggcctggagtgggtggccagcatcagcaacgagggcaacaagaagtaccacggcgaggccgtgtggggcagattcatcatcagcagagacaacagcaagaagaccctgttcctgcacatgagcaacctgagagccgacgacagcggcctgtacttctgcgtgagagacagacaggaggacgagtgcgaggagtggtggagcgactactacagcttcggcagaggcggcccctgcagaaagtaccacggccagggcctggccggcatcttcgacatctggggcagaggcaccctggtgaccgtgagcagc

SEQ ID NO: 32253 - RNA, 435 nt, synthetic construct
  misc_feature 1..435: note = derived and/or modified sequence opt4 from anti-HIV_cap256-206-179686_VR-Chain
  source 1..435: mol_type = other RNA
caggagcagctggtggagagcggcggcggcgtggtgcccccctggaagagcctgaccctgagctgcgaggccagcagattcaccttcagcgccttcggcatgcactgggtgagacaggcccccggcaagggcctggagtgggtggccggcatcagcttcgccggcatcaagaagtactacgccgacagcgtgaagggcagattcttcatcagcagagacaacagcaagaacagagtgctgctggagatgaacggcctgagaagagaggacaccgccagatacttctgcgtgaaggacctgagagagctggagtgcgaggagtgggccagcgactactacgacttcggcaagcccaaccagccctgcctggacagaagaggcgtgagcggcatcagcgccatgtggggccagggcaccatggtgaccgtgagcagc

SEQ ID NO: 32254 - RNA, 417 nt, synthetic construct
  misc_feature 1..417: note = derived and/or modified sequence opt4 from anti-HIV_cap256-206-173707_VR-Chain
  source 1..417: mol_type = other RNA
caggagaagctggtggagagcggcggcggcgccgtgcagcccggcggcagcctgagactgagctgcgtggccagcggcttcaccttcaagggcttcggcatgcactgggtgagacaggcccccggcaagggcctggagtgggtggccaccatcagcttcagcggcgtgaagaagtactacggcaacagcgccaagggcagattcttcatcagcagagacaacctgaagaacaccgtgtacctggagatgaacggcctgagaggcgaggacaccgccctgtactactgcgccaaggacctgagatacctggagtgcggcgagtggagcacctactacccccagccctgcctggacaccagaggcgtgagcggcatcagcaacgtgtggggccccggcaccaaggtgaccgtgagcagc

SEQ ID NO: 32255 - RNA, 432 nt, synthetic construct
  misc_feature 1..432: note = derived and/or modified sequence opt4 from anti-HIV_cap256-206-173339_VR-Chain
  source 1..432: mol_type = other RNA
caggagctgctggtggagagcggcggcggcgtggtgccccccggcaagagcctgaagctgagctgcgtggccagcagattcaccttcggcgccttcggcatgcactgggtgagacaggcccccggcaagggcctggagtgggtggccggcatcagcttcgccggcaccaagaactactacgccgacagcgtgaagggcagattcaccatcagcagagacaaccccaagaacaccctgttcctgcagatgaacggcctgagaggcgacgacaccggcctgtactactgcgtgaaggacatgagagagctggagtgcgagctgtggaccagcgactactacgacttcggcagaccccagccctgcatcgaccagagaggcgtgagcggcatcagcgccatgtggggccagggcaccatggtgaccatcagcagc

SEQ ID NO: 32256 - RNA, 438 nt, synthetic construct
  misc_feature 1..438: note = derived and/or modified sequence opt4 from anti-HIV_cap256-206-172689_VR-Chain
  source 1..438: mol_type = other RNA
cagatgatgctggtggagagcggcggcggcgtggtggagcccggcagaagcctgaccctgagctgcgccaccagccacttcaccttcagcaactacggcatgcactgggtgagacaggcccccggcggcagactggagtgggtggccagcatcagcaacgccggcaacaagaagtaccacggcgacagcgtgtggggcagactgatcatcagcagagacaacagcaagaacaccctgttcctgcacatgagcagcctgagagtggacgacagcgccctgtacttctgcgtgagagacagacaggaggacgagtgcgaggagtggtggagcgactactacgccttcggcagaggcggcccctgcagaaagtacagaggccagggcctggccggcatcttcgacatctggggcagaggcaccatggtgaccgtgagcagc

SEQ ID NO: 32257 - RNA, 432 nt, synthetic construct
  misc_feature 1..432: note = derived and/or modified sequence opt4 from anti-HIV_cap256-206-162744_VR-Chain
  source 1..432: mol_type = other RNA
caggagaagctggtggagagcggcggcggcgtggtgccccccggcaagagcctgagactgagctgcgtggccagcggcttcaccttcagcgccttcggcatgcactgggtgagacaggcccccggcaagggcctggagtgggtggccggcatcagcttcgccggcatcaagaactactacgccgacagcgtgaagggcagattcaccatcagcagagacaacagcaagaacagcctgttcctgcagatgaacggcctgagaggcgacgacaccgccagatactactgcgtgaaggacatgagagagctggagtgcgaggagtggaccagcgactactacgacttcggcaagccccagccctgcatcgacagaagaggcgtgagcggcatcagcgccatgtggggccagggcaccatggtgaccatcagcagc

SEQ ID NO: 32258 - RNA, 438 nt, synthetic construct
  misc_feature 1..438: note = derived and/or modified sequence opt4 from anti-HIV_cap256-206-146057_VR-Chain
  source 1..438: mol_type = other RNA
cagatgcagctggtggagagcggcggcggcgtggtgcagcccggcaccagcctgaccctgagctgcgtggccagccagttcaccttcagcaactacggcatgcactggatcagacaggcccccggccagggcctggagtgggtggccagcatcagcaacgacggcggcaagagataccacggcgacgccgtgtgggccagattcatcatcagcagagacaacagcaagaacaccgtgttcctgcagatgaccagcctgagagccgaggacaccgccagatacttctgcgtgagagacagacaggaggacgagtgcctggagtggtggagcgactactacaacttcggcagacagctgccctgcgccaagttcagaggcctgggcctggccggcgtgttcgacatctggggccacggcaccatggtgaccgtgagcagc

SEQ ID NO: 32259 - RNA, 435 nt, synthetic construct
  misc_feature 1..435: note = derived and/or modified sequence opt4 from anti-HIV_cap256-206-139519_VR-Chain
  source 1..435: mol_type = other RNA
caggagcagctggtggagagcggcggcggcgtggtgccccccggcaccagcctgagactgagctgcgtggccagcagattcagcttcggcagcttcggcatgcactgggtgagacaggcccccggcaagggcctggagtgggtggccggcatcagcttcgtgggcatcaagaagtactacggcgacagcgtgaagggcagattcttcatcagcagagacaacagcaagaacaccctgttcctggagatgaacggcctgagaggcgaggacaccgccagatactactgcgtgaaggacatgagagagctggagtgcgaggagtgggccagcgactactacgacttcggcaagcccaaccagccctgcctggacagaagaggcgtgagcggcatcagcgccatgtggggccccggcaccatgctgaccgtgagcagc

SEQ ID NO: 32260 - RNA, 432 nt, synthetic construct
  misc_feature 1..432: note = derived and/or modified sequence opt4 from anti-HIV_cap256-206-136316_VR-Chain
  source 1..432: mol_type = other RNA
caggagcagctggtggagagcggcggcggcgtggtgccccccggcaagagcctgaccctgagctgcgtggccagcggcttcaccttcagcgccttcggcatgcactgggtgagacaggcccccggcaagggcctggagtgggtggccggcatcagcttcgtgggcatcaagaagtactacggcgacagcgtgaagggcagattcaccatcagcagagacaacagcaagaacaccctgttcctgcagatgaacggcctgagaggcgacgacaccgccctgtaccactgcgtgaaggacatgagacagctggagtgcgaggagtggaccagcgactactacgacttcggcaagccccagccctgcatcgaccccagaggcgtgagcggcatcagcgccatgtggggccagggcaccatggtgaccgtgagcagc

SEQ ID NO: 32261 - RNA, 438 nt, synthetic construct
  misc_feature 1..438: note = derived and/or modified sequence opt4 from anti-HIV_cap256-206-116098_VR-Chain
  source 1..438: mol_type = other RNA
cagatgatgctggtggagagcggcggcggcgtggtggagcccggcagaagcctgaccctgagctgcgccgccagccagttcaccttcagcaactacggcatgcactgggtgagacaggcccccggcagagagctggagtgggtggccagcatcagcaacgccggcaacaagaagtaccacggcgaggccgtgtggggcagactgatcatcagcagagacaacagcaagaacaccctgttcctgcacatgagcaacctgagacccgacgacagcgccctgtacttctgcgtgagagacagacaggaggacgagtgcgaggagtggtggagcgactactacgccttcggcagaggcggcccctgcagaaagtaccacggccagggcctggccggcatcttcgacatctggggcagaggcaccatggtgaccgtgagcagc

SEQ ID NO: 32262 - RNA, 432 nt, synthetic construct
  misc_feature 1..432: note = derived and/or modified sequence opt4 from anti-HIV_cap256-206-115862_VR-Chain
  source 1..432: mol_type = other RNA
caggagcagctggtggagagcggcggcggcgtggtgccccccggcaagagcctgagactgagctgcgtgggcagcagattcaccttcagcgccttcggcatgcactgggtgagacaggcccccggcaagggcctggagtgggtggccagcatcagcttcgccggcaccaagaagtactacgtggacagcgtgaagggcagattcttcatcagcagagacaacagcaagaacaccgtgttcctggagatgaacggcctgagaggcgaggacaccggcctgtactactgcgtgaaggacatgagagagctggagtgcgaggagtgggccagcgactactacgacttcggcaagccccagccctgcctggacagaagaggcgtgagcggcatcagcgccatgtggggccagggcaccctggtgatcatcagcagc

SEQ ID NO: 32263 - RNA, 435 nt, synthetic construct
  misc_feature 1..435: note = derived and/or modified sequence opt4 from anti-HIV_cap256-206-107018_VR-Chain
  source 1..435: mol_type = other RNA
caggagcagctggtggagagcggcggcggcgtggtgccccccggcaagagcctgaccctgagctgcgtggccagcagattcagcttcagcgccttcggcatgcactgggtgagacaggcccccggcaagggcctggagtgggtggccagcatcagcttcgtgggcatcaagaagtactacggcgacagcgtgaagggcagattcttcatcagcagagacaacagcaagaacaccgtgttcctggagatgaacggcctgagaggcgaggacaccggcctgtactactgcgtgaaggacatgagagagctggagtgcgaggagtgggccagcgactactacgacttcggcaagcccaaccagccctgcctggacagaagaggcgtgagcggcatcagcgccatgtggggccagggcaccctggtgatcgtgagcagc

SEQ ID NO: 32264 - RNA, 438 nt, synthetic construct
  misc_feature 1..438: note = derived and/or modified sequence opt4 from anti-HIV_cap256-206-098644_VR-Chain
  source 1..438: mol_type = other RNA
cagatgctgctggtggagagcggcggcggcgtggtggagcccggcagaagcctgaccctgagctgcgccgccagccagttcaccttcagcaactacggcatgcactgggtgagacaggcccccggcggcggcctggagtgggtggccagcatcagcaacgagggcaacaagagataccacggcgagagcgtgtggggcagattcgtgatcagcagagacaacagcaagaacaccctgttcctgcacatgagcaccctgagacccgacgacagcgccctgtacttctgcgtgagagacagacaggaggacgagtgcgaggagtggtggagcgactactacgccttcggcagaggcggcccctgcagaaagtaccacggccagggcctggccggcatcttcgacgtgtggggcagaggcaccatggtgaccggcctgttc

SEQ ID NO: 32265 - RNA, 417 nt, synthetic construct
  misc_feature 1..417: note = derived and/or modified sequence opt4 from anti-HIV_cap256-206-098135_VR-Chain
  source 1..417: mol_type = other RNA
caggagaagctggtggagagcggcggcggcgccgtgcagcccggcggcagcctgagactgagctgcgtggccagcggcttcaccttcagcggcttcggcatgcactgggtgagacaggcccccggcaagggcctggagtgggtggccaccatcagcttcagcggcatgaagaagtactacggcaccagcgccaagggcagattcagcatctacagagacaacagcaagaacaccctgtacctgcagatggacggcctgagagagaaggacaccgccctgtactactgcgccaaggacctgagatacctggagtgcggcgagtggagcacctactacccccagccctgcctggacagaagaggcgtgagcggcatcagcaacgtgtggggccccggcaccatggtgaccgtgagcagc

SEQ ID NO: 32266 - RNA, 435 nt, synthetic construct
  misc_feature 1..435: note = derived and/or modified sequence opt4 from anti-HIV_cap256-206-096276_VR-Chain
  source 1..435: mol_type = other RNA
caggagcagctggtggagagcggcggcggcgtggtgccccccggcagcagcctgagactgagctgcgtggccagcagattcaccttcagcgccttcggcatgcactgggtgagacaggcccccggcaagggcctggagtgggtggccggcatcagcttcgtgggcatcaagaagtactacgccgacagcgtgaagggcagattcaccatcagcagagacaacagcaagaacaccctgttcctgcagatgaacggcctgagaggcgaggacaccggcctgtactactgcgtgaaggacatgagagagctggagtgcgaggagtggagaagcgactactacgacttcggcaagcccaaccagccctacctggacagaagaggcgtgagcggcatcagcgccttctggggccagggcaccatggtgaccgtgagcagc

SEQ ID NO: 32267 - RNA, 438 nt, synthetic construct
  misc_feature 1..438: note = derived and/or modified sequence opt4 from anti-HIV_cap256-206-092794_VR-Chain
  source 1..438: mol_type = other RNA
cagatgatgctggtggagagcggcggcggcgtggtggagcccggcagaagcctgaccctgagctgcgccaccagccagttcaccttcagcaactacggcatgcactgggtgagacaggcccccggcagaggcctggagtgggtggccagcatcagcaacgagggcaacaagagataccacggcgagagcgtgtggggcagattcatcatcagcagagacaacagcaagaacaccctgttcctgcacatgagcaccctgagagccgacgacagcgccctgtacttctgcgtgagagacagacaggaggacgagtgcgaggagtggtggagcgactactacgccttcggcagaggcggcccctgcagaaagtaccacggccagggcctggccggcatcttcgacatcgtgggcagaggcaccctggtgaccgtgagcagc

SEQ ID NO: 32268 - RNA, 432 nt, synthetic construct
  misc_feature 1..432: note = derived and/or modified sequence opt4 from anti-HIV_cap256-206-086817_VR-Chain
  source 1..432: mol_type = other RNA
caggagcagctggtggagagcggcggcggcgtggtgccccccggcaagagcctgagactgagctgcgccgccagcggcttcagcttcggcgccttcggcatgcactgggtgagacaggcccccggcaagggcctggagtgggtggccggcatcagcttcgtgggcatcaagtactactacgccgacagcgtgaagggcagattcaccatcagcagagacaacagcaagaacaccgtgttcctgcagatgaacggcctgagaggcgacgacaccggcagatactactgcgtgaaggacatgagagagctggagtgcgaggagtggaccagcgactactacgacttcggcaagccccagccctgcatcgacagaagaggcgtgagcggcatcagcgccatgtggggccagggcaccatggtgaccatcagcagc

SEQ ID NO: 32269 - RNA, 432 nt, synthetic construct
  misc_feature 1..432: note = derived and/or modified sequence opt4 from anti-HIV_cap256-206-086446_VR-Chain
  source 1..432: mol_type = other RNA
caggagcagctggtggagagcggcggcggcgtggtgccccccggcaagagcctgagactgagctgcgtggccagcagattcaccttcagcgccttcggcatgcactgggtgagacaggcccccggcaagggcctggagtgggtggccggcatcagcttcgtgggcatcaagaagtactacagcgacgccgtgaagggcagattctacatcagcagagacaacagcaagaacaccctgttcctggagatgaacggcctgagaggcgacgacaccgccagatactactgcgtgaaggacctgagagagctggagtgcgaggagtgggccagcgactactacgacttcggcaagccccagccctgcctggacagcagaggcgtgagcggcatcagcgccatgtggggccagggcaccatggtgaccgtgagcagc

SEQ ID NO: 32270 - RNA, 432 nt, synthetic construct
  misc_feature 1..432: note = derived and/or modified sequence opt4 from anti-HIV_cap256-206-086180_VR-Chain
  source 1..432: mol_type = other RNA
caggagcagctggaggagagcggcggcggcgtggtgccccccggcaagagcctgagactgagctgcgtggccagcagattcaccttcagcgccttcggcatgcactgggtgagacaggcccccggcaagggcctggagtgggtggccggcatcagcttcgtgggcatcaagaagtactacgccgacagcgtgaagggcagattcaccatcagcagagacaacagcaagaacaccctgttcctgcagatgaacggcctgagaggcgacgacaccggcctgtacttctgcgtgaaggacatgagagagctggagtgcgagcagtggaccagcgactactacgacttcggcaagccccagccctgcatcgaccccagaggcgtgagcggcatcagcgccatgtggggccagggcaccatggtgaccgtgagcagc

SEQ ID NO: 32271 - RNA, 435 nt, synthetic construct
  misc_feature 1..435: note = derived and/or modified sequence opt4 from anti-HIV_cap256-206-083708_VR-Chain
  source 1..435: mol_type = other RNA
caggagcagctggtggagagcggcggcggcgtgatcccccccggccagagcctgagactgagctgcgtggccagcagattcaccttcagcgccttcggcatgcactgggtgagacaggcccccggcaagggcctggagtgggtgagcagcgtgagcttcgccggcatcaagaagtactacgccgacagcgtgaagggcagattcttcatcagcagagacaacagcaagaacaccgtgttcctggagatgaacggcctgagaggcgaggacaccggcctgtactactgcgtgaaggacatgagagagctggagtgcgaggagtgggccagcgactactacgacttcggcaagcccgaccagccctgcctggacagaagaggcgtgagcggcatcagcgccatgtggggccagggcaccctggtgatcgtgagcagc

SEQ ID NO: 32272 - RNA, 432 nt, synthetic construct
  misc_feature 1..432: note = derived and/or modified sequence opt4 from anti-HIV_cap256-206-079556_VR-Chain
  source 1..432: mol_type = other RNA
caggagcagctggtggagagcggcggcggcgtggtgccccccggcaagagcctgagactgagctgcgtggccagcggcttcaccttcagcggcttcggcatgcactgggtgagacaggcccccggcaagggcctggagtgggtggccggcatcagcttcgtgggcatcaagtactactacgccgacagcgtgaagggcagattcagcatcagcagagacaacagcaagaacaccctgttcctgcagatgaacggcctgagaggcgacgacaccgccctgtactactgcgtgaaggacatgagagagctggagtgcgaggagtggaccagcgactactacgacttcggcaagccccagccctgcatcgacagaagaggcgtgagcggcatcagcgccatgtggggccagggcaccatggtgaccgtgagcagc

SEQ ID NO: 32273 - RNA, 438 nt, synthetic construct
  misc_feature 1..438: note = derived and/or modified sequence opt4 from anti-HIV_cap256-206-078657_VR-Chain
  source 1..438: mol_type = other RNA
cagatgctgctggtggagagcggcggcggcgtggtggagcccggcagaagcctgaccctgagctgcgccaccagccagttcaccttcagcaactacggcatgcactgggtgagacaggcccccggcagaggcctggagtgggtggccagcatcagcaacgagggcagcaagaagtaccacggcgagcccgtgtggggcagattcatcatcagcagagacaacagcaagaagaccctgttcctgcacatgagcaacctgagagtggacgacagcgccctgtacttctgcgtgagagacagacaggaggacgagtgcgaggagtggtggagcgactactacgccttcggcagaggcggcccctgcagaaagtaccacggccagggcctggccggcatcttcgacatctggggcagaggcaccatggtgaccgtgagcagc

SEQ ID NO: 32274 - RNA, 438 nt, synthetic construct
  misc_feature 1..438: note = derived and/or modified sequence opt4 from anti-HIV_cap256-206-075802_VR-Chain
  source 1..438: mol_type = other RNA
cagatgctgctggtggagagcggcggcgacgtggtggagcccggcaagagcctgaccctgagctgcgccaccagcagattcaccttcagcaactacggcatgcactgggtgagacaggcccccggcggcggcctggagtgggtggccagcatcagcaacgagggcaacaagaagtaccacggcgagagcgtgtggggcagattcatcatcagcagagacaacagcaagaacaccctgttcctgcacatgagcgccctgagaaccgacgacagcgccctgtacttctgcgtgagagacagacaggaggacgagtgcgaggagtggtggagcgactactacgccttcggcagaggcggcccctgcagaaagtaccacggccagggcctggccggcatcttcgacatctggggcagaggcaccatggtgaccgtgagcagc

SEQ ID NO: 32275 - RNA, 438 nt, synthetic construct
  misc_feature 1..438: note = derived and/or modified sequence opt4 from anti-HIV_cap256-206-069097_VR-Chain
  source 1..438: mol_type = other RNA
cagatgctgctggtggagagcggcggcggcgtggtggagcccggcagaagcctgaccctgagctgcgccaccagcagattcaccttcagcaactacggcatgcactgggtgagacaggcccccggcagagagctggagtgggtggccagcatcagcaacgagggcaacaagaagtaccacgccgagagcgtgtggggcagattcatcatcagcagagacaacagcaagaacaccctgttcctgcacatgagcaacgtgagaggcgacgacagcgccctgtacttctgcgtgagagacagacaggaggacgagtgcgaggagtggtggagcgactactacgccttcggcagaggcggcccctgcagaaagtaccacggccagggcctggccggcatcttcgacgtgtggggcagaggcaccgtggtgaccgtgagcagc

SEQ ID NO: 32276 - RNA, 438 nt, synthetic construct
  misc_feature 1..438: note = derived and/or modified sequence opt4 from anti-HIV_cap256-206-067758_VR-Chain
  source 1..438: mol_type = other RNA
cagatgctgctggtggagagcggcggcggcgtggtggagcccggcagaagcctgaccctgagctgcgccgccagccagttcaccttcagccactacggcatgcactgggtgagacaggcccccggcagaggcctggagtgggtggccagcatcagcaacgagggcaacaagagataccacggcgagagcgtgtggggcagattcatcatcagcagagacaacagcaagaacaccctgttcctgcacatgagcgccctgagaaccgacgacagcgccctgtacttctgcgtgagagacagacaggaggacgagtgcgaggagtggtggagcgactactacgccttcggcagaggcggcccctgcagaaagtggcacggccagggcctggccggcatcttcgacatctggggcagaggcaccgtggtgaccgtgagcagc

SEQ ID NO: 32277 - RNA, 417 nt, synthetic construct
  misc_feature 1..417: note = derived and/or modified sequence opt4 from anti-HIV_cap256-206-057019_VR-Chain
  source 1..417: mol_type = other RNA
caggagaagctggtggagagcggcggcggcgccgtgcagcccggcggcagcctgagactgagctgcgtggccagcggcttcagcttcagcggctacggcatgcactgggtgagacaggcccccggcaagggcctggagtggctggccaccatcagcttcagcggcgtgaagaagtactacggcaccagcgccaagggcagattctacatctacagagacaacaccaagaacaccatgtacctggagatgaacggcctgagaggcgaggacaccgccctgtactactgcgccaaggacctgagatacctggagtgcggcgagtggagcacctactacccccagccctgcctggacaccagaggcgtgagcggcatcagcaacgtgtggggccccggcaccatggtgaccgtgagcagc

SEQ ID NO: 32278 - RNA, 438 nt, synthetic construct
  misc_feature 1..438: note = derived and/or modified sequence opt4 from anti-HIV_cap256-206-055385_VR-Chain
  source 1..438: mol_type = other RNA
cagatgatgctggtggagagcggcggcggcgtggtggagcccggcagaagcctgaccctgagctgcgccgccagcaagttcaccttcagcaactacggcatgcactgggtgagacaggcccccggcagaggcctggagtgggtggccagcatcagcaacgagggcaacaagaagtaccacggcgagcccgtgtggggcagactgatcatcagcagagacaacagcaagaacaccctgttcctgcacatgagcgacctgagagccgacgacagcgccctgtacttctgcgtgagagacagacaggaggacgagtgcgaggagtggtggagcaactactacgccttcggcagaggcggcccctgcagaaagtggagaggccagggcctggccggcatcttcgacgtgtggggcagaggcaccatggtgaccgtgagcagc

SEQ ID NO: 32279 - RNA, 435 nt, synthetic construct
  misc_feature 1..435: note = derived and/or modified sequence opt4 from anti-HIV_cap256-206-053187_VR-Chain
  source 1..435: mol_type = other RNA
caggagcagctggtggagagcggcggcggcgtggtgccccccggcagcagcctgagactgagctgcgtggccagcagattcaccttcagcgccttcggcatgcactgggtgagacaggcccccggcaagggcctggagtgggtggccggcatcagcttcgtgggcatcaagtactactacgccgacagcgtgaagggcagattcaccatcagcagagacaacagcaagaacaccctgttcctgcagatgaacggcctgagaggcgaggacaccggcctgtactactgcgtgaaggacatgagagagctggagtgcgaggagtgggccagcgactactacgacttcggcaagcccaaccagccctgcctggacagaagaggcgtgagcggcatcagcgccttctggggccagggcaccatggtgaccgtgagcagc

SEQ ID NO: 32280 - RNA, 438 nt, synthetic construct
  misc_feature 1..438: note = derived and/or modified sequence opt4 from anti-HIV_cap256-206-053139_VR-Chain
  source 1..438: mol_type = other RNA
cagatgctgctggtggagagcggcggcgacgtggtggagcccggcagaagcctgaccctgagctgcgccaccagccagttcaccttcagcaactacggcatgcactgggtgagacaggcccccggcagaggcctggagtgggtggccagcatcagcaacgagggcagcaagaagtaccacggcgagagcgtgtggggcagattcatcatcagcagagacaacagcaagaacaccctgttcctgcacatgaccaccctgagacccgacgacagcgccctgtacttctgcgtgagagacagacaggaggacgagtgcgaggagtggtggagcgactactacgccttcggcagaggcggcccctgcagaaagtaccacggccagggcctggccggcatcttcgacatctggggcagaggcaccatggtgaccgtgagcagc

SEQ ID NO: 32281 - RNA, 432 nt, synthetic construct
  misc_feature 1..432: note = derived and/or modified sequence opt4 from anti-HIV_cap256-206-050350_VR-Chain
  source 1..432: mol_type = other RNA
caggagcagctggtggagagcggcggcggcgtggtgccccccggcaagagcctgaagctgagctgcgtggccagcagattcagcttcggcgccttcggcatgcactgggtgagacaggcccccggcaagggcctggagtgggtggccggcatcagcttcgtgggcatcaagaagtactacgccgacagcgtgaagggcagattctacatcagcagagacaacagcaagaacaccgtgttcctggagatgaacgccctgagaggcgaggacaccgccctgtaccactgcgtgaaggacatgagagagctggagtgcgaggagtgggccagcgactactacgacttcggcaagccccagccctgcctggacagaagaggcgtgagcggcatcagcgccatgtggggccccggcaccatggtgatcgtgagcagc

SEQ ID NO: 32282 - RNA, 432 nt, synthetic construct
  misc_feature 1..432: note = derived and/or modified sequence opt4 from anti-HIV_cap256-206-046207_VR-Chain
  source 1..432: mol_type = other RNA
caggagcagctggtggagagcggcggcggcgtggtgccccccggcaccagcctgagactgagctgcgtggccagcagattcaccttcagcgccttcggcatgcactgggtgagacaggcccccggcaagggcctggagtgggtggccggcatcagcttcgccggcatcaagaagtactacgccgacagcgtgaagggcagattcaccatcagcagagacaacagcaagaacagcctgttcctggagatgaacggcctgagaggcgacgacaccgccctgtactactgcgtgaaggacctgagatacctggagtgcgagctgtggaccagcgactactacgacttcggcagaccccagccctgcatcgacagcagaggcgtgagcggcatcagcgccatgtggggccccggcaccatggtgaccgtgagcgcc

SEQ ID NO: 32283 - RNA, 417 nt, synthetic construct
  misc_feature 1..417: note = derived and/or modified sequence opt4 from anti-HIV_cap256-206-043389_VR-Chain
  source 1..417: mol_type = other RNA
caggagaagctggtggagagcggcggcggcgccgtgcagcccggcggcagcctgagactgagctgcgtggccagcggcttcaccttcagcggcttcggcatgcactggttcagacaggcccccggcaagggcctggagtgggtggccaccatcagcttcagcggcatcaagaagtactacaacaccagcgccaagggcagattcttcatcagcagagacaacaccaaggacaccctgtacctgcagatggacggcctgcaggagaaggacaccgccctgtacctgtgcgccaaggacctgagatacctggagtgcggctactggagcacctactacccccagccctgcctggacaccagaggcgtgagcggcatcagcaacgtgtggggccccggcaccatggtgaccgtgagcagc

SEQ ID NO: 32284 - RNA, 432 nt, synthetic construct
  misc_feature 1..432: note = derived and/or modified sequence opt4 from anti-HIV_cap256-206-042555_VR-Chain
  source 1..432: mol_type = other RNA
caggagcagctggtggagagcggcggcggcgtggtgccccccggcaagagcctgagactgagctgcgtggtgagcggcttcaccttcagcgccttcggcatgcactgggtgagacaggcccccggcaagggcctggagtgggtggccggcatcagcttcgccggcaccaagagctactacgccgagagcgtgaagggcagattcaccatcagcagagacaacagcaagaacagcctgttcctgcagatgaacggcctgagaggcgacgacaccgccctgtactactgcgtgaaggacatgagagagctggagtgcgagctgtggaccagcgactactacgacttcggcagaccccagccctgcatcgacagaagaggcgtgagcggcatcagcgccatgtggggccagggcaccatggtgaccatcagcagc

SEQ ID NO: 32285 - RNA, 432 nt, synthetic construct
  misc_feature 1..432: note = derived and/or modified sequence opt4 from anti-HIV_cap256-206-029720_VR-Chain
  source 1..432: mol_type = other RNA
caggagaagctggtggagagcggcggcggcgtggtgcagcccggcagaagcctgaccctgagctgcgtggccagccacttcaccttcagcggcgtgggcatgcactgggtgagacaggcccccggcaagggcctggagtgggtggccggcatcagcttcgccggcaccagaaagtactacgccgacagcgtgaagggcagattcaccatcagcagagacaacagcaagaacaccgtgtacctgcagatgaacggcctgagaggcgaggacaccgccctgtaccactgcgccaaggacctgagagagctggagtgcgagctgtggaccagcgactactacgacttcggcagaccccagccctgcatcgacagaagaggcgtgagcggcatctgcgacatgtggggccagggcaccatggtgatcgtgagcagc

SEQ ID NO: 32286 - RNA, 432 nt, synthetic construct
  misc_feature 1..432: note = derived and/or modified sequence opt4 from anti-HIV_cap256-206-028848_VR-Chain
  source 1..432: mol_type = other RNA
caggagcagctggtggagagcggcggcggcgtggtgccccccggcaagagcctgagactgagctgcgtggccagcggcttcaccttcagcggcttcggcatgcactgggtgagacaggcccccggcaagggcctgcagtgggtggccggcatcagcttcgccggcaccaagtactactacgaggacagcgtgaagggcagattcaccatcagcagagacaacagcaagaacaccgtgttcctgcagatgaacggcctgagaggcgacgacaccgccctgtactactgcgtgaaggacatgagagagctggagtgcgaggagtggaccagcgactactacgacttcggcaagccccagccctgcatcgacagaagaggcgtgagcggcatcagcgccatgtggggccagggcaccatggtgaccatcagcagc

SEQ ID NO: 32287 - RNA, 432 nt, synthetic construct
  misc_feature 1..432: note = derived and/or modified sequence opt4 from anti-HIV_cap256-206-027652_VR-Chain
  source 1..432: mol_type = other RNA
caggagcagctggtggtgagcggcggcgacgtggtgccccccggcaagagcctgagactgagctgcgtggccagcggcttcaccttcagcgccttcggcatgcactgggtgagacaggcccccggcaagggcctggagtgggtggccagcatcagcttcgccggcaccaagtactactacgccgacagcgtgaagggcagattcgccatcagcagagacaacagcaagaacaccctgttcctgcagatgaacggcctgagaagagaggacaccggcctgtactactgcgtgaaggacatgagacagctggagtgcgaggagtggaccagcgactactacgacttcggcagaccccagccctgcatcgacagaagaggcgtgagcggcatcagcgccatgtggggccagggcaccatggtgaccatcagcagc

SEQ ID NO: 32288 - RNA, 417 nt, synthetic construct
  misc_feature 1..417: note = derived and/or modified sequence opt4 from anti-HIV_cap256-206-024075_VR-Chain
  source 1..417: mol_type = other RNA
caggagaagctggtggagagcggcggcggcgccgtgcagcccggcggcagcctgagactgagctgcgtggccagcggcttcaccttcagcggcttcggcatgcactgggtgagacaggcccccggcaagggcctggagtggctggccaccatcagcttcagcggcgtgaagaagtactacggcaccagcgccaagggcagattctacatcagcagagacaacaccaagaacaccgtgtacctgcagatggacggcctgagaggcgacgacaccgccatctactactgcgccaaggacctgagattcctggagtgcggcctgtggagcacctactacccccagccctgcctggacaccagaggcgtgagcggcatcagcaacgtgtggggccccggcaccatggtgaccgtgagcagc

SEQ ID NO: 32289 - RNA, 417 nt, synthetic construct
  misc_feature 1..417: note = derived and/or modified sequence opt4 from anti-HIV_cap256-206-008748_VR-Chain
  source 1..417: mol_type = other RNA
caggagaagctggtggagagcggcggcggcgccgtgcagcccggcggcagcctgagactgagctgcgtggccagcggcttcaccttcaacggcttcggcatgcactgggtgagacaggcccccggcaagggcctggagtgggtggccaccatcagcttcagcggcgtgaagaagtactacggcaccagcgccaagggcagattcttcatcagcagagagaacagcaagaacaccctgtacctgcagatgaacggcctgagaggcgaggacaccgccctgtactactgcgccaaggacctgagatacctggagtgcggcgagtggagcacctactacccccagccctgcctggacaccagaggcgtgagcggcatcagcaacgtgtggggccccggcaccagagtgaccgtgagcagc

SEQ ID NO: 32290 - RNA, 432 nt, synthetic construct
  misc_feature 1..432: note = derived and/or modified sequence opt4 from anti-HIV_cap256-206-008530_VR-Chain
  source 1..432: mol_type = other RNA
caggagcagctggtggagagcggcggcggcgtggtgccccccggcaagagcctgagactgagctgcgtggccagcggcttcagcttcggcgccttcggcatgcactgggtgagacaggcccccggcaagggcctggagtgggtggccggcatcagcttcgtgggcatcaagtactactacgccgacagcgtgaagggcagattcaccatcagcagagacaacagcaagaagaccctgttcctgcagatgaacggcctgagaggcgacgacaccgccctgtactactgcgtgaaggacatgagagagctggagtgcgaggagtggaccagcgactactacgacttcggcaagccccagccctgcatcgacagaagaggcgtgagcggcatcagcgccttctggggccagggcaccatggtgaccatcagcagc

SEQ ID NO: 32291 - RNA, 432 nt, synthetic construct
  misc_feature 1..432: note = derived and/or modified sequence opt4 from anti-HIV_cap256-176-723043_VR-Chain
  source 1..432: mol_type = other RNA
caggagcagctggtggagagcggcggcggcgtggtgccccccggcaagagcctgagactgagctgcgtggccagcggcttcaccttcagcgccttcggcatgcactgggtgagacaggcccccggcaagggcctggagtgggtggccggcgtgagcttcgccggcatcaagtactactacgccgacagcgtgaagggcagattcaccatcagcagagacaacagcaagaacaccctgttcctgcagatgaacggcctgagaggcgacgacaccgccctgtactactgcgtgaaggacctgagagagctggagtgcgaggagtggaccagcgactactacgacttcggcagaccccagccctgcatcgaccccagaggcgtgagcggcatcagcgccatgtggggccagggcaccgtggtgaccatcagcagc

SEQ ID NO: 32292 - RNA, 432 nt, synthetic construct
  misc_feature 1..432: note = derived and/or modified sequence opt4 from anti-HIV_cap256-176-600049_VR-Chain
  source 1..432: mol_type = other RNA
gaggtgcagctggtgcagagcggcggcggcgtggtgcagcccggcagaagcctgagactgagctgcgccgccccctacttcgagttcggcagatacggcttccactgggtgagacaggcccccggcaagggcctggagtgggtggccagcatcagcttcgccggcagaggctactaccacagccccagcgtgtggggcagattcaccatcagcagagacaacagcaagaacaccctgtacctgcagatgaacagcctgagaatcgaggacaccgccctgtacttctgcgccagagacctgagagagagcgagtgcgaggagtgggagagcgactactacgacttcggcaagaagggcccctgcgtgaagcccagaggcgtggccggcggcctggacctgtggggccagggcaccatggtgatcgtgagcagc

SEQ ID NO: 32293 - RNA, 432 nt, synthetic construct
  misc_feature 1..432: note = derived and/or modified sequence opt4 from anti-HIV_cap256-176-531926_VR-Chain
  source 1..432: mol_type = other RNA
caggtgcagctggtggagagcggcggcggcgtggtgccccccggcaagagcctgaccctgagctgcgtggccagcagattcaccttcagcgccttcggcatgcactgggtgagacaggcccccggcaagggcctggagtgggtggccggcatcagcttcgtgggcatcagaaagtactacgccgacagcgtgaagggcagattcagcatcagcagagacaacagcaagaacaccgtgttcctggagatgaacggcctgagaggcgaggacaccggcctgtactactgcgtgaaggacatgagagagctggagtgcgaggagtgggccagcgactactacgacttcggcaagccccagccctgcctggacagaagaggcgtgagcggcatcagcgccatgtggggccagggcaccctggtgatcatcagcagc

SEQ ID NO: 32294 - RNA, 432 nt, synthetic construct
  misc_feature 1..432: note = derived and/or modified sequence opt4 from anti-HIV_cap256-176-504134_VR-Chain
  source 1..432: mol_type = other RNA
gaggtgcagctggtggagagcggcggcggcgtggtgccccccggcaagagcctgagactgagctgcgtgaccagcagactggccttcggcgccttcggcatgcactgggtgagacaggcccccggcaagggcctggagtgggtggccagcatcagcttcgccggcatcaagaagtactacgccgacagcgtgaagggcagattcaccatcagcagagacaacagcaaggacaccgtgttcctggagatgaacggcctgagaggcgacgacaccggcctgtactactgcgtgaaggacatgagatacctggagtgcgaggagtgggccagcgactactacgacttcggcagaccccagccctgcctggaccccagaggcgtgagcggcatcagcgccatgtggggccagggcaccctggtgatcatcagcagc

SEQ ID NO: 32295 - RNA, 432 nt, synthetic construct
  misc_feature 1..432: note = derived and/or modified sequence opt4 from anti-HIV_cap256-119-186229_VR-Chain
  source 1..432: mol_type = other RNA
cagatgcagctggtggagagcggcggcggcgtggtgcagcccggcggcagcctgagactgctgtgcagcgccagcggcttcaccttcagcacctacggcatgcactgggtgagacaggcccccggcaagggcctggagtgggtggccagcatcagctacgacggcagcgacaagtaccacgccggcctggtgtggggcagattcatcatcagcagagacaacagcaagaacaccctgtacctgcagatgaacagcctgagagccgaggacaccgccctgtactactgcgtgagagacgagagagagagcgagtgcgagctgtgggagagcgactactacaacttcggcaagaagctgccctgcgtgaagcccagaggcgtggccggcaccctggacatctggggccagggcaccaccgtgatcgtgagcagc

SEQ ID NO: 32296 - RNA, 432 nt, synthetic construct
  misc_feature 1..432: note = derived and/or modified sequence opt4 from anti-HIV_cap256-119-183891_VR-Chain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcaccagatacgacggcagcgacaagtactacctggacagcgtgaagggcagattcaccatcagcagagacaacagcaagtacaccctgttcctgcagatggtgagcctgagaaccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32297 - RNA, 435 nt, synthetic construct
  misc_feature 1..435: note = derived and/or modified sequence opt4 from anti-HIV_cap256-119-183631_VR-Chain
  source 1..435: mol_type = other RNA
caggtgcagctggtgcagagcggcggcggcgtggtgcagcccggcagaagcctgagactgagctgcgccgccagcaagttcaccttcagcacctacaccctgcactgggtgagacaggcccccggcaagggcctggagtgggtggccgtgatcagccacgacggcggcaacagattctacgccgacagcgtgaagggcagattcaccatcagcagagacaacagcaagaacaacctgttcctgcagatgaacagcctgagagtggaggacaccgccctgtactactgcgccagagacctgagagagatggagtgcgaggagtggaccctgtacaactactacgacttcggcagcagaggcccctgcgtggaccccagaggcgtggtgggcagcttcgacgtgtggggccagggcaccatggtgaccgtgagcagc

SEQ ID NO: 32298 - RNA, 432 nt, synthetic construct
  misc_feature 1..432: note = derived and/or modified sequence opt4 from anti-HIV_cap256-119-182676_VR-Chain
  source 1..432: mol_type = other RNA
caggtgcagctggtggagagcggcggcggcgtggtgcagcccggcaagagcctgagactgagctgcgtggtgagcggcttcaccttcagcaactaccccatgcactgggtgagacaggcccccggcaagggcctggagtgggtggccagcatcagcttcgccggcatcaagaagtactacggcgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32299 - RNA, 432 nt, synthetic construct
  misc_feature 1..432: note = derived and/or modified sequence opt4 from anti-HIV_cap256-119-180772_VR-Chain
  source 1..432: mol_type = other RNA
caggtgcagctggtggagagcggcggcggcgtggtgcagcccggcagaagcctgagactgagctgcgccgccagcgagttcaccttcagcaactacgccatgcactgggtgagacaggcccccggcaagggcctggagtgggtggccagcatcagcttcgacggcagagacaagtaccacagcagcctggtgtggggcagactgaccatcagcagagacaacagcaagagcaccctgttcctgcagatgaacagcctgagacccgaggacaccgccctgtactactgcgccagagacgtgagagagagcgagtgcgaggagtggcagagcgactactacgccttctacagaaagctgccctgcgtgaagcccagaggcgtggccggcaccctggacatctggggccagggcaccatggtgaccgtgagcagc

SEQ ID NO: 32300 - RNA, 435 nt, synthetic construct
  misc_feature 1..435: note = derived and/or modified sequence opt4 from anti-HIV_cap256-119-180508_VR-Chain
  source 1..435: mol_type = other RNA
caggtgcacctggtggagagcggcggcggcgtggtgcagcccggcagaagcctgagactgagctgcgccgccagccacttcagcctgagcagctacggcatgcactgggtgagacagacccccggcaagggcctggagtgggtggccggcatcagcttcgccggcgtgaagacctactacggcaccagcgtgaagggcagattcaccatcagcagagacaacagcaagaacaacctgtacctgcagatgaacagcctgagacccgaggacaccgccctgtactactgcgccagagacctgagagagatggagtgcgaggagtggaagctgtacaactactacgacttcagaaccagaggcccctgcgtggaccccagaggcgtggtgggcagcttcgacgtgtggggccagggcaccgtggtgaccgtgagcagc

SEQ ID NO: 32301 - RNA, 432 nt, synthetic construct
  misc_feature 1..432: note = derived and/or modified sequence opt4 from anti-HIV_cap256-119-180260_VR-Chain
  source 1..432: mol_type = other RNA
gaggtgcagctggtggagagcggcggcggcgtggtgagacccggcggcagcctgagactgagctgcgccgccagccagttcaccttcagcaacttcggcatgcactgggtgagacaggcccccggcaagggcctggagtgggtggccagcatcagcttcgtgggcatcaagacccactacgccaacagcgtgagaggcagattcaccatcagcagagaccagagcaagaacaccctgtacctgcagatgaacagcgtgagagtggaggacaccggcagatactactgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32302 - RNA, 432 nt, synthetic construct
  misc_feature 1..432: note = derived and/or modified sequence opt4 from anti-HIV_cap256-119-180173_VR-Chain
  source 1..432: mol_type = other RNA
gaggtgcagctggtggagagcggcggcggcctggtgcagcccggcggcagcctgagactgagctgcgccgccagcggcttcaccgtgagcagcaactacatgagctgggtgagacaggcccccggcaagggcctggagtgggtggccagcatcagcttcgccggcaccaagaagcactacggcaacagcgtgaagggcagattcaccatcagcagagacaacagcaagaacaccctgtacctgcagatgaacagcctgagaggcgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32303 - RNA, 432 nt, synthetic construct
  misc_feature 1..432: note = derived and/or modified sequence opt4 from anti-HIV_cap256-119-179839_VR-Chain
  source 1..432: mol_type = other RNA
caggtgcagctggtggagagcggcggcggcgtggtgcagcccggcagaagcctgagactgagctgcgccgccagcggcttcagcttcggcaccagcgacgtgcactgggtgagacaggcccccggcgagggcctggagtgggtggccctgatcagcttcgacggcagacagaaggacctggccgacagcgtgagaggcagattcaccatcagcagagacagcagcaagaacaccctgtacctggagatgaacagcctgagacccgaggacaccgccctgtactactgcgccaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32304 - RNA, 423 nt, synthetic construct
  misc_feature 1..423: note = derived and/or modified sequence opt4 from anti-HIV_cap256-119-179262_VR-Chain
  source 1..423: mol_type = other RNA
caggtgcagctggtggagagcggcggcagagtggtgcagagcggcggcagcctgagactgagctgcggcgccagcggcttcagcttcaccaccagcgccatgcactgggtgagacaggcccccggcaagggcctggagtgggtggccatcaacggcgccaacaagcactacgccgagagcgtgaagggcagattcaccatcagcagagacaacagcaagaacaccctgttcctggagatgaacagcctgagacccgacgacaccgccctgtacttctgcgtgaaggaccagagagaggacgagtgcgaggagtggtggagcgactactacgacttcggcagagagcagccctgcctggaccccagaggcgtggtgggcatcttcgacctgtggggccagggcaccatggtgaccgtgagcagc

SEQ ID NO: 32305 - RNA, 432 nt, synthetic construct
  misc_feature 1..432: note = derived and/or modified sequence opt4 from anti-HIV_cap256-119-178995_VR-Chain
  source 1..432: mol_type = other RNA
caggtgcagctggtggagagcggcggcggcgtggtgcagcccggcaagagcctgagactgagctgcgccgccagcggcttcaccctgaccagattcgccatgcactgggtgagacaggcccccggcaagggcctggagtgggtggccgtgatctggtacgacggcagcaacaagtactacgccgacagcgtgaagggcagattcaccgtgagcagagacaacagcaagaacaccctgtacctgcagatgaacagcctgagaaccgaggacaccgccctgtactactgcgtgagagacagaagagagagcgagtgcgagctgtgggagagcgactactacaacttcggcagaagactgccctgcgtgaagcccagaggcgtggccggcatcctggacatctggggccagggcaccaccgtgaccgtgagcccc

SEQ ID NO: 32306 - RNA, 432 nt, synthetic construct
  misc_feature 1..432: note = derived and/or modified sequence opt4 from anti-HIV_cap256-119-178455_VR-Chain
  source 1..432: mol_type = other RNA
gaggtgcagctggtggagagcggcggcggcctggtgcagcccggcggcagcctgagactgagctgcgtggtgagcggcttcaccttcagcaacttctggatgagctgggtgagacaggcccccggcaagggcctggagtgggtggccagcatcagctacgacggcagagacaagtaccacagcagcctggtgtggggcagactgaccatcagcagagacaacagcaagagcaccctgttcctgcagatgaacagcctgagagccgaggacaccgccctgtactactgcgccagagacctgagagagagcgagtgcgaggagtggcagagcgactactacgccttctacaagaagctgccctgcgtgaagcccagaggcgtggccggcaccctggacatctggggccagggcaccatggtgaccgtgagcagc

SEQ ID NO: 32307 - RNA, 438 nt, synthetic construct
  misc_feature 1..438: note = derived and/or modified sequence opt4 from anti-HIV_cap256-119-177993_VR-Chain
  source 1..438: mol_type = other RNA
caggtgcacctggtggagagcggcggcggcgtggtgcagcccggcaagagcctgagaatctactgcgccgtgagcgagttcaccttcagcaactacgccatgcactgggtgagactggcccccggcagaggcctgcagtggctggccgtgatcagctacgacggcagcaagaagtactacgccgacagcctggagggcagattcaccatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcgagagagcccccctgcccaaggtgcccggccccggccccggctggaacctggacatgtggggccacggcaccatggtgaccgtgagcagc

SEQ ID NO: 32308 - RNA, 438 nt, synthetic construct
  misc_feature 1..438: note = derived and/or modified sequence opt4 from anti-HIV_cap256-119-177727_VR-Chain
  source 1..438: mol_type = other RNA
caggtgcagctggtggagagcggcggcggcgtggtgcagcccggcagaagcctgagactgagctgcgccgccagcggcttcaccctgagcagatacgacatgcactgggtgagacaggcccccggcaagggcctggagtgggtggccagcatcagcaaggacggcaccaagaagtaccacggcgacagcgtgtggggcagattcatcatcagcagagacaacagcaagaacaccctgttcctgcagatgagcagcctgagagccgaggacaccgccctgtacttctgcgtgagagaccagagagaggccgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32309 - RNA, 432 nt, synthetic construct
  misc_feature 1..432: note = derived and/or modified sequence opt4 from anti-HIV_cap256-119-176746_VR-Chain
  source 1..432: mol_type = other RNA
gaggtgcagctggtggagagcggcggcggcctggtgcagcccggcggcagcctgagactgagctgcgccgccagcgacttcaccttcgacgactacgccatgcactgggtgagacaggcccccggcaagggcctggagtgggtgggcggcatcagctacgacggcagcgacaagtaccacaccaacagcgtgtggggcagattcatcgtgagcagagacaacagcaagaacaccctgtacctgcagatgaacagcctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32310 - RNA, 432 nt, synthetic construct
  misc_feature 1..432: note = derived and/or modified sequence opt4 from anti-HIV_cap256-119-176241_VR-Chain
  source 1..432: mol_type = other RNA
caggtgcagctggtggagagcggcggcggcgtggtgcagcccggcagaagcctgagactgagctgcgccgccagcggcttcaccttcagcaactacgccatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32311 - RNA, 432 nt, synthetic construct
  misc_feature 1..432: note = derived and/or modified sequence opt4 from anti-HIV_cap256-119-175215_VR-Chain
  source 1..432: mol_type = other RNA
caggtgcagctggtggagagcggcggcggcgtggtgcagcccggcagaagcctgagactgagctgcgccgtgagccagttcaccttcggcagatacggcatgtactgggtgagacaggcccccggcaagggcctggagtgggtggccggcatcagctacgacggcagcgacaagtaccacaccaacagcgtgtggggcagattcatcgtgagcagagacaacagcaagaacatgctgtacctgcagatgaacaacctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32312 - RNA, 432 nt, synthetic construct
  misc_feature 1..432: note = derived and/or modified sequence opt4 from anti-HIV_cap256-119-173928_VR-Chain
  source 1..432: mol_type = other RNA
ggcgtggagctgctggagagcggcggcggcctggtggagcccggcggcagcctgagactgagctgcgtgggcagccagttcagcttcgacagatacggcatgcactgggtgagacaggcccccggcaagggcctggagtgggtggccgccgtgagcttcgacggcaccgacaagtaccacgccgacgacgtgtggggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacctgggcaagcagctgccctgcagaaagagcagaggcgtggccggcgtgctggacaagtggggcctgggcaccatggtgaccgtgagcagc

SEQ ID NO: 32313 - RNA, 432 nt, synthetic construct
  misc_feature 1..432: note = derived and/or modified sequence opt4 from anti-HIV_cap256-119-173495_VR-Chain
  source 1..432: mol_type = other RNA
caggtgcagctggtggagagcggcggcggcgtggtgcagcccggcaagagcctgagactgagctgcgccgccagcagattcaccttcaacagatacggcatgcactgggtgagacaggcccccggcaagggcctggagtgggtggccgccatcagcttcgacggcaccgacaagtaccacagcgacgacgtgtggggcagattcaccatcagcagagacaacagcaagaacaccctgtacctgcagatgaacagcctgagagccgaggacaccgccgtgtactactgcgccaaggacctgagagaggacgagtgcgaggagagatggagcgactactacgacttcggcaagcagctgccctgcagaaagagcagaggcgtggccggcatcttcgacaactggggccagggcaccatggtgaccgtgagcagc

SEQ ID NO: 32314 - RNA, 432 nt, synthetic construct
  misc_feature 1..432: note = derived and/or modified sequence opt4 from anti-HIV_cap256-119-172882_VR-Chain
  source 1..432: mol_type = other RNA
caggtgcagctggtggagagcggcggcggcgtggtgcagcccggcagaagcctgaccctgagctgcgaggtgagcggcttcaccttcaagacctacggcatgcactgggtgagacaggcccccggcaagggcctggagtgggtggccagcatcagctacgacggcagcgacaagtaccacgccgacagagtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32315 - RNA, 432 nt, synthetic construct
  misc_feature 1..432: note = derived and/or modified sequence opt4 from anti-HIV_cap256-119-172429_VR-Chain
  source 1..432: mol_type = other RNA
gaggtgcagctggtggagaccggcggcggcctgatccagcccggcggcagcctgagactgagctgcgtggccagccagttcaccttcagcggctgcggcctgcactgggtgagacaggcccccggcaagggcctggagtgggtggccagcatcagcttcgccggcaccaagaagcactacggcaacagcgtgaagggcagattcaccatcagcagagacaacagcaagaacaccctgtacctggagatgaacaccctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgagcgtgagcagc

SEQ ID NO: 32316 - RNA, 432 nt, synthetic construct
  misc_feature 1..432: note = derived and/or modified sequence opt4 from anti-HIV_cap256-119-172223_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaaggacccctgcgtgaagcccagaggcgtggtgggcgtgctggacatctggggccagggcaccctggtgaccgtgagcagc

SEQ ID NO: 32317 - RNA, 432 nt, synthetic construct
  misc_feature 1..432: note = derived and/or modified sequence opt4 from anti-HIV_cap256-119-171838_VR-Chain
  source 1..432: mol_type = other RNA
caggtgcagctgggcgagagcggcggcggcgtggtgcagcccggcagaagcctgagactgagctgcgccgccagcggcttcaccttcagcaccttcgccatgcactgggtgagacaggcccccggcaagggcctggagtgggtggccgtgatcagctacgacggcagcaacaagtactacgccgacagcgtgaagggcagattcgccatcagcagagacaacgccaagaacctgctgcacctgcagatgaacagcctgagacccgaggacaccgccctgtactactgcgccaaggacctgcaggaggacgagtgcgaggagtggtggagcgactactacgacttcggcaagcagctgccctgcagaaagagcagaggcgtggccggcatcttcgacgactggggccagggcaccatggtgaccgtgagcagc

SEQ ID NO: 32318 - RNA, 432 nt, synthetic construct
  misc_feature 1..432: note = derived and/or modified sequence opt4 from anti-HIV_cap256-119-171587_VR-Chain
  source 1..432: mol_type = other RNA
gaggtgcagctggtggagagcggcggcggcctggtgcagcccggcggcagcctgagactgagctgcgccgccagcggcttcaccttcagcgactactacatgagctggatcagacaggcccccggcaagggcctggagtgggtggccagcatcagcttcgccggcaccaagcagcactacggcaacagcgtgaagggcagattcaccatcagcagagacaacagcaagaacaccgtgtacctgcagatgaacagcctgagactggaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32319 - RNA, 432 nt, synthetic construct
  misc_feature 1..432: note = derived and/or modified sequence opt4 from anti-HIV_cap256-119-169596_VR-Chain
  source 1..432: mol_type = other RNA
ctggtgcagctggtggagagcggcggcggcgtggtgcagcccggcagaagcctgagactgagctgcaccgccagcggcttcaccttcagcagcttcgccatgcacagagtgagacagacccccggcaagggcctggagtgggtggccagcatcagctacgacggcagcgacaagtaccacgccgacagagtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32320 - RNA, 432 nt, synthetic construct
  misc_feature 1..432: note = derived and/or modified sequence opt4 from anti-HIV_cap256-119-169523_VR-Chain
  source 1..432: mol_type = other RNA
caggtgcagctggtggagagcggcggcggcgtggtgcagcccggcgagagcctgagactgagctgcgccgccagcggcttcagcttcggcaccagcgacgtgcactgggtgagacaggcccccggcgagggcctggagtgggtggccagcatcagcttcgccggcatcaagaagtactacggcgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32321 - RNA, 432 nt, synthetic construct
  misc_feature 1..432: note = derived and/or modified sequence opt4 from anti-HIV_cap256-119-169462_VR-Chain
  source 1..432: mol_type = other RNA
gaggtgcagctggtggagagcggcggcggcctggtgcagcccggcggcagcctgagactgagctgcgccgccagcggcttcaccttcaccacctacagcctgcactgggtgagacagagccccggcaagggcctggagtgggtggccgccatcagcttcgccggcaccaaggagaactacgccaacagcgtgagaggcagattcaccatcagcagagacaacagcaagaacaccctgtacctgcagatgaacagcctgagagccgaggacaccgccctgtactactgcaccaaggacatgagagagtacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32322 - RNA, 432 nt, synthetic construct
  misc_feature 1..432: note = derived and/or modified sequence opt4 from anti-HIV_cap256-119-169092_VR-Chain
  source 1..432: mol_type = other RNA
gaggtgcagctggtggagagcggcggcggcctggtgcagcccggcggcagcctgagactgagctgcgtgatcagcggcttcaccttcagcagctacgagatgaactgggtgagacaggcccccggcaagggcctggagtgggtggccggcatcagctacgacggcagagacaagtaccacgcccacttcgtgtggggcagaatcaccatcagcagagacaacagcaagaacaccctgtacctgcagatgaacagcctgagagccgaggacaccgccctgtaccactgcgtgagagacctgagagagagcgagtgcgagctgtgggagagcgactactacgacttcggcaagaagctgccctgcgtgaagcccagaggcgtggccggcatcttcgacctgtggggccagggcaccatggtgaccgtgagcagc

SEQ ID NO: 32323 - RNA, 432 nt, synthetic construct
  misc_feature 1..432: note = derived and/or modified sequence opt4 from anti-HIV_cap256-119-168680_VR-Chain
  source 1..432: mol_type = other RNA
caggtgcagctggtggagagcggcggcggcgtggtgcagcccggcagaagcctgagagtgagctgcgccgccagccacttcaccttcagcagatacggcatgcactgggtgagacaggcccccggcaagggcctggagtgggtggccagcatcagctacgacggcagagacttctaccacgccagaagcgtgtggggcagattcgccatcagcagagacaacagcaagaacaccctgcacctgcagatgaacagcctgagaaccgaggacaccgccctgtaccactgcgtgagagacctgagagagagcgagtgcgagctgtgggagagcgactactacgacttcggcaagaagctgccctgcgtgaagcccagaggcgtggccggcaccttcgacctgtggggccagggcaccatggtgaccgtgagcagc

SEQ ID NO: 32324 - RNA, 438 nt, synthetic construct
  misc_feature 1..438: note = derived and/or modified sequence opt4 from anti-HIV_cap256-119-166385_VR-Chain
  source 1..438: mol_type = other RNA
caggtgcagctggtggagagcggcggcggcgtggtgcaccccggcagaagcctgagactgagctgcgccgccagcggcttcagcttcggcaacttcggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32325 - RNA, 432 nt, synthetic construct
  misc_feature 1..432: note = derived and/or modified sequence opt4 from anti-HIV_cap256-119-165943_VR-Chain
  source 1..432: mol_type = other RNA
gaggtgcagctggtggagagcggcggcggcctggtgcagcccggcagaagcctgagactgagctgcgccgtgagcggcttcaccgtgagcagcaactacatgagctgggtgagacaggcccccggcaagggcctggagtgggtggccagcatcagcttcgccggcatcaagaagtactacggcgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32326 - RNA, 432 nt, synthetic construct
  misc_feature 1..432: note = derived and/or modified sequence opt4 from anti-HIV_cap256-119-165738_VR-Chain
  source 1..432: mol_type = other RNA
gaggtgcagctggtggagagcggcggcggcctggtgcagcccggcagaagcctgagactgagctgcgccgccagcggcttcaccttcgacgactacgccatgaactgggtgagacaggcccccggcaagggcctggagtgggtggccaccatcagcttcgacggcaccgacaagtaccacgccgacgacgtgtggggcagattcaccatcagcagagacaacagcaagaagaccctgtacctgcagatgaacagcctgagagccgaggacaccgccctgtactactgcgccaaggacctgagagaggacgagtgcgaggagtggtggagcgactactacgacctgggcaagcagctgccctgcagaaagagcagaggcgtggccggcgtgctggacaagtggggcctgggcaccatggtgaccgtgagcagc

SEQ ID NO: 32327 - RNA, 432 nt, synthetic construct
  misc_feature 1..432: note = derived and/or modified sequence opt4 from anti-HIV_cap256-119-164913_VR-Chain
  source 1..432: mol_type = other RNA
caggaccacctggtggagagcggcggcggcggcgtgcagcccggcaagagcctgagactgagctgcgccgccagcggcttcaccttcagcgcccacgccatgcactgggtgagacaggcccccggcaagggccccgagtgggtggccgtgatcagccacgacggcggccagcagttctacagagagagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32328 - RNA, 432 nt, synthetic construct
  misc_feature 1..432: note = derived and/or modified sequence opt4 from anti-HIV_cap256-119-164167_VR-Chain
  source 1..432: mol_type = other RNA
gaggtgagactggtggagagcggcggcggcctgatccagcccggcggcagcctgagactgagctgcgccgccagcggcctgaccgtgagcagcaaccacatgagctgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32329 - RNA, 432 nt, synthetic construct
  misc_feature 1..432: note = derived and/or modified sequence opt4 from anti-HIV_cap256-119-163558_VR-Chain
  source 1..432: mol_type = other RNA
cagatgcagctggtggagagcggcggcggcgtggtgcagcccggcagaagcctgaccctgagctgcgccgccagccagttcaacttcgccaactacggcatgcactgggtgagacaggcccccggcaagggcctggagtgggtggccagcatcagctacgacggcagcgacaagtaccacgccgacagagtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32330 - RNA, 432 nt, synthetic construct
  misc_feature 1..432: note = derived and/or modified sequence opt4 from anti-HIV_cap256-119-162043_VR-Chain
  source 1..432: mol_type = other RNA
caggtgcagctggtggagagcggcggcggcgtggtgcagcccggcagaagcctgagagtgagctgcgccgccagccacttcaccttcagcagatacggcatgcactgggtgagacaggcccccggcaagggcctggagtgggtgaccggcatcagcttcgccgccaccaagacctactacggcgacagcgtgagaggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcatcctggacctgtggggccagggcaccatggtgaccgtgagcagc

SEQ ID NO: 32331 - RNA, 432 nt, synthetic construct
  misc_feature 1..432: note = derived and/or modified sequence opt4 from anti-HIV_cap256-119-161718_VR-Chain
  source 1..432: mol_type = other RNA
caggtgcagctggtggagagcggcggcggcgtggtgcagcccggcaagagcctgagactgagctgcgccgccagccacttcagcttcaacagatacggcatgcactgggtgagacaggcccccggcaagggcctggagtgggtggccgccatcagctacgacggcaccgacaagtaccacgccgaccaggtgtggggcagattcaccatcagcagagacaacagcaagaacaccctgtacctgcagatgaacagcctgagacccgaggacaccgccctgtactactgcgccaaggacctgagagaggacgagtgcgaggagtggtggagcgactactacgacctgggcaagcagctgccctgcagaaagagcagaggcgtggccggcatcttcgacaagtggggccagggcaccatggtgaccgtgagcagc

SEQ ID NO: 32332 - RNA, 432 nt, synthetic construct
  misc_feature 1..432: note = derived and/or modified sequence opt4 from anti-HIV_cap256-119-161675_VR-Chain
  source 1..432: mol_type = other RNA
caggtgcagctggtggagagcggcggcggcgtggtgcagcccggcagaagcctgagactgagctgcaccgccagcggcttcaccttcagcatctacagcatgaactgggtgagacaggcccccggcaagggcctggactgggtggccggcatcagcttcgccgccaccaagacctactacggcggcagcgtgaagggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32333 - RNA, 432 nt, synthetic construct
  misc_feature 1..432: note = derived and/or modified sequence opt4 from anti-HIV_cap256-119-161053_VR-Chain
  source 1..432: mol_type = other RNA
caggtgcacctggtggagagcggcggcggcgtggtgcagcccggcaccagcctgagactgagctgcgtggccagcggcttcaccttcagcaacttcgccatgcactgggtgagacaggcccccggcaagggcctggagtgggccgccatcatcagcaccagaggcaacaacagaaactacgccgacagcgtgagaggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcatcctggacctgtggggccagggcaccatggtgaccgtgagcagc

SEQ ID NO: 32334 - RNA, 432 nt, synthetic construct
  misc_feature 1..432: note = derived and/or modified sequence opt4 from anti-HIV_cap256-119-159499_VR-Chain
  source 1..432: mol_type = other RNA
caggtgcagctggtggagagcggcggcggcgtggtgcagcccggcagaagcctgagactgagctgcgccgccagcggcttcgccttcagccactacggcatcttctgggtgagacaggcccccggcaagggcctggagtgggtggccagcatcagcttcgacggcagagactactaccacagcccccacgtgtggggcagactgaccatcagcagagacaacagcaagaacaccctgtacctgcagatgaacagcctgagagccgaggacaccgccctgtactactgcgccagagacctgagagagagcgagagagaggagtgggagagcgactactacgacttcggcaagaagggcccctgcgtgaagcccagaggcgtggccggcagcctggacatgtggggccagggcaccatggtgatcgtgagcagc

SEQ ID NO: 32335 - RNA, 432 nt, synthetic construct
  misc_feature 1..432: note = derived and/or modified sequence opt4 from anti-HIV_cap256-119-159114_VR-Chain
  source 1..432: mol_type = other RNA
gaggtgcagctggtggagagcggcggcggcctggtgcagcccggcggcagcctgagactggcctgcgccgccagcggcctgaccttcagaaagcacggcatgcactgggtgagacaggcccccggcaagggcctggagtgggtgagctacatcagcagcgacggcgtgaacaactacctgatcgacagcgtgagaggcagattcaccgtgagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32336 - RNA, 432 nt, synthetic construct
  misc_feature 1..432: note = derived and/or modified sequence opt4 from anti-HIV_cap256-119-156751_VR-Chain
  source 1..432: mol_type = other RNA
gaggtgcagctgctggagagcggcggcggcctggtgcagcccggcggcagcctgagactgagctgcgccgccagcggcttcgccttcagcagctacggcatgcactgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32337 - RNA, 432 nt, synthetic construct
  misc_feature 1..432: note = derived and/or modified sequence opt4 from anti-HIV_cap256-119-155656_VR-Chain
  source 1..432: mol_type = other RNA
gaggtgcagctggtggagagcggcggcggcctggtgcagcccggcggcagcctgagactgagctgcgccgccagcggcatcaccttcagcagctacggcatgcactgggtgagacaggcccccggcaagggcctggagtgggtggccttcatcagatacgacggcagcagcaagtactacgccgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32338 - RNA, 432 nt, synthetic construct
  misc_feature 1..432: note = derived and/or modified sequence opt4 from anti-HIV_cap256-119-154420_VR-Chain
  source 1..432: mol_type = other RNA
caggtgagactggtggagagcggcggcggcgtggtgcagcccggcagaagcctgagaatcagctgcgccgccagccagttcatgttcagcagatacggcatgcactgggtgagacaggcccccggcaagggcctggagtgggtggccagcatcagctacgacggcaccgacaagtaccacgccgacctggtgtggggcagattcaccatcagcagagacaacagcaagaacaccctgtacctgcagatgaacagcctgagagccgaggacaccgccctgtactactgcgccagagacctgagagagagcgagtgcgaggagtgggagagcgactactacgacttcggcaagaagggcccctgcgtgaagcccagaggcgtggccggcagcctggacatgtggggccagggcaccatggtgatcgtgagcagc

SEQ ID NO: 32339 - RNA, 432 nt, synthetic construct
  misc_feature 1..432: note = derived and/or modified sequence opt4 from anti-HIV_cap256-119-153954_VR-Chain
  source 1..432: mol_type = other RNA
gaggtgcaggtgctggagagcggcggcggcctggtgcagcccggcggcagcctgagactgagctgcgtggccagccagttcaccttcagcggctgcggcctgcactgggtgagacaggcccccggcaagggcctggagtgggtggccagcatcagcttcgccggcaccaagaagcactacggcaacagcgtgaagggcagattcaccatcagcagagacaacagcaagaacaccgtgtacctggagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32340 - RNA, 432 nt, synthetic construct
  misc_feature 1..432: note = derived and/or modified sequence opt4 from anti-HIV_cap256-119-153864_VR-Chain
  source 1..432: mol_type = other RNA
caggtgcacctggtggagagcggcggcggcgtggtgcagcccggcggcagcctgagactgagctgcgccgccagcggcttcaccttcagcggctgcggcctgcactgggtgagacaggcccccggcaagggcctggagtgggtggccagcatcagcttcgccggcaccaagaagcactacggcagcagcgtgagaggcagattcagcatcagcagagacaacagcaagaacaccctgtacctgcagatgaacagcctgagaaccgaggacaccgccctgtacttctgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32341 - RNA, 432 nt, synthetic construct
  misc_feature 1..432: note = derived and/or modified sequence opt4 from anti-HIV_cap256-119-153793_VR-Chain
  source 1..432: mol_type = other RNA
gaggtgcagctggtggagagcggcggcggcgtggtgcagcccggcggcagcctgagactgagctgcgccaccagcggcttcaccttcggcaccttcggcatgcactgggtgagacaggcccccggcaagggcctggactgggtggcctacatcagatacgacggcaagaccaagaactacggcgagagcgtgaagggcagattcaccatcagcagagacaacagcaagaacaccatgagcctgcagatgaacagcctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32342 - RNA, 432 nt, synthetic construct
  misc_feature 1..432: note = derived and/or modified sequence opt4 from anti-HIV_cap256-119-153462_VR-Chain
  source 1..432: mol_type = other RNA
caggtgcagctggtggagagcggcggcggcgtggtgcagcccggcggcagcctgagactgagctgcgccgccagcggcttcaccttcagcaactacggcatgcagtgggtgagacaggcccccggcaagggcctggagtgggtggccgccatcagctacgacggcagaaacgagtactacgccgagagcgtgaagggcagattcaccatcagcagagacaacttcaagagcaccctgttcctgcagatgaacagcctgagagccgaggacaccgccctgtactactgcgccagagacctgagagagagcgagtgcgaggagtgggagagcgactactacgccttctacagaaagctgccctgcgtgaagcccagaggcgtggccggcaccctggacatctggggccagggcaccatggtgaccgtgagcagc

SEQ ID NO: 32343 - RNA, 438 nt, synthetic construct
  misc_feature 1..438: note = derived and/or modified sequence opt4 from anti-HIV_cap256-119-153124_VR-Chain
  source 1..438: mol_type = other RNA
caggtgcagctggtggagagcggcggcggcgtggtgcagcccggcagaagcctgaccctgagctgcatcgccagccagttcaacttcgccagctacggcatgcactgggtgagacaggcccccggcaagggcctggagtgggtggccagcatcagccacgacggcaccaagaagtaccacgccgagagcgtgtggggcagattcaccatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32344 - RNA, 438 nt, synthetic construct
  misc_feature 1..438: note = derived and/or modified sequence opt4 from anti-HIV_cap256-119-153025_VR-Chain
  source 1..438: mol_type = other RNA
cagatgcagctggtggagagcggcggcggcgtggtgcagcccggcaagagcctgaccctgagctgcgccgccagccagttcaccttcagcaactacggcatgcactgggtgagacaggcccccggcaagggcctggagtgggtggccagcatcagcaacgacggcaacaagaagtaccacggcgacagcgtgtggggcagactgaccatcagcagagacaacagcaagaacaccctgttcctgcagatgaacagcctgagacccgaggacaccgccctgtacttctgcgtgaaggaccagagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32345 - RNA, 432 nt, synthetic construct
  misc_feature 1..432: note = derived and/or modified sequence opt4 from anti-HIV_cap256-119-152713_VR-Chain
  source 1..432: mol_type = other RNA
gaggtgcagctggtggagagcggcggcggcctggtgagacccggcggcagcctgagactgagctgcgccaccagcggcttcaccttcagcagccactggatgagctgggtgagacaggcccccggcaagggcctggagtgggtggccggcatcagcttcgccggcaccaagacctactacggcgacagcgtgaagggcagattcaccgtgagcaccgacatcagcaagaacaccctgtacctgcaggtgaacagcctgagacccgaggacaccgccatgtactactgcgccagagaccagagatactacgagtgcgaggagtgggccagcgactactacgacttcggcaaggagcagccctgcctggaccccagaggcgtggtgggcatcttcgacatctggggccagggcaccatggtgaccgtgagcagc

SEQ ID NO: 32346 - RNA, 438 nt, synthetic construct
  misc_feature 1..438: note = derived and/or modified sequence opt4 from anti-HIV_cap256-119-151794_VR-Chain
  source 1..438: mol_type = other RNA
cacgtgcagctggtggagagcggcggcggcgtggtgcagcccggcaccagcctgagactgagctgcgtggccagcgagttcagcttcaagaactacggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32347 - RNA, 438 nt, synthetic construct
  misc_feature 1..438: note = derived and/or modified sequence opt4 from anti-HIV_cap256-119-150980_VR-Chain
  source 1..438: mol_type = other RNA
caggtgcagctggtggagagcggcggcggcgtggtgcagcccggcaagagcctgagactgagctgcgccgccagcggcttcatcctgagcaactacgccatgcactgggtgagacaggcccccggcaagggcctggagtgggtggccagcatcagcaacgacggcagcaagaagtaccacggcgacagcgtgtgggccagattcatcatcagcagagacaacagcaagaacaccctgttcctgcagatgagcagcctgagagccgaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32348 - RNA, 432 nt, synthetic construct
  misc_feature 1..432: note = derived and/or modified sequence opt4 from anti-HIV_cap256-119-148895_VR-Chain
  source 1..432: mol_type = other RNA
caggtgcagctggtggagagcggcggcggcgtggtgcagcccggcagaagcctgagactgagctgcgccgccagcggcttcaccttcagaagctacggcatgcactgggtgagacaggcccccggcaagggcctggagtgggtggccgtgatcagcagcgacggcgacatcgagtactacacccagagcgtgaagggcagattcaccatcagcagagacaacagcaagaacaccctgtacctgcagatgaacgccctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32349 - RNA, 438 nt, synthetic construct
  misc_feature 1..438: note = derived and/or modified sequence opt4 from anti-HIV_cap256-119-148848_VR-Chain
  source 1..438: mol_type = other RNA
cagatgcagctggtggagagcggcggcggcgtggtgcagcccggcagaagcctgaccctgagctgcgccgccagccagttcagcttcaccagctacggcatgcactgggtgagacaggcccccggcaagggcctggagtgggtggccagcatcagcaacgacggcaccaagaagtaccacggcgagagcgtgtgggacagattcagcatcagcagagacaacagcaagaacaccctgttcctgcagatgaacagcctgagagtggaggacaccgccctgtacttctgcgtgaaggaccagagagaggacgagtgcgaggagtggtggagcgactactacgacttcggcaaggagctgccctgcagaaagtggaagaccagaggcgtggccggcatcctggacaactggggccagggcaccatgctgaccgtgagcagc

SEQ ID NO: 32350 - RNA, 432 nt, synthetic construct
  misc_feature 1..432: note = derived and/or modified sequence opt4 from anti-HIV_cap256-119-148743_VR-Chain
  source 1..432: mol_type = other RNA
caggtgcagctggtggagagcggcggcggcgtggtgcagcccggcagaagcctgaccctgagctgcgccgccagccagttcaacttcgccaactacggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcaagaagctgccctgcagaaagagcagaggcctggccggcatcttccacgtgtggggccacggcaccatggtgaccgtgagcagc

SEQ ID NO: 32351 - RNA, 432 nt, synthetic construct
  misc_feature 1..432: note = derived and/or modified sequence opt4 from anti-HIV_cap256-119-148595_VR-Chain
  source 1..432: mol_type = other RNA
gaggtgcagctggtggagagcggcggcggcctggtgcagcccggcggcagcctgagactgagctgcgccgccagcagattcaccttcgacaactacggcatgcactgggtgagacaggcccccggcaagggcctggagtgggtggccctgctgaactacgacggcagcaagaagtactacgtggacagcgtgaagggcagattcatcatcttcagagacaacagcaagaacaccctgttcctgcagatgaacagcctgagacccgaggacaccgccctgtacttctgcgtgaaggaccagagagaggacgcctgcgaggagtggtggagcgactactacgacttcggcaagaagctgccctgcagaaagagcagaggcctggccggcatcttccacgtgtggggccacggcaccatggtgaccgtgagcagc

SEQ ID NO: 32352 - RNA, 432 nt, synthetic construct
  misc_feature 1..432: note = derived and/or modified sequence opt4 from anti-HIV_cap256-119-148490_VR-Chain
  source 1..432: mol_type = other RNA
caggtgcagctggtggagagcggcggcggcgtggtgcagcccggcagaagcctgagactgagctgcgtggccagcggcttcaccttcagcgactacgccatgcactgggtgagacaggcccccggcaagggcctggagtgggtggccaccatcagcttcgacggcgccgacaagtaccacgccgacgacgtgtggggcagattcaccatcagcagagacaacagcaagaacaccctgtacctgcagatgaacagcctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32353 - RNA, 438 nt, synthetic construct
  misc_feature 1..438: note = derived and/or modified sequence opt4 from anti-HIV_cap256-119-148470_VR-Chain
  source 1..438: mol_type = other RNA
caggtgcagctggtggagagcggcggcggcgtggtgcagcccggcagaagcctgagactgagctgcgtggccagcggcttcaccttcagcagctacggcatccactgggtgagacaggcccccggcaagggcctggagtgggtggccgtgatcagcgacgacggcagcaagaagtaccacgaggagagcgtgtggggcagattcaccatcagcaaggacaacagcaagaacaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32354 - RNA, 432 nt, synthetic construct
  misc_feature 1..432: note = derived and/or modified sequence opt4 from anti-HIV_cap256-119-148107_VR-Chain
  source 1..432: mol_type = other RNA
gaggtgcagctggtggagagcggcggcggcctggtgcagcccggcggcagcctgagactgagctgcgccgccagcggcttcaccgtgagcagcaactacatgacctgggtgagacaggcccccagaaagggcctggagtgggtgggcagcatcagctacgacggcagcgacaagtaccacaccaacagcctgtggggcagattcatcgtgagcagagacaacagcaagaacaccctgtacctgcagatgaacaacctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32355 - RNA, 432 nt, synthetic construct
  misc_feature 1..432: note = derived and/or modified sequence opt4 from anti-HIV_cap256-119-147933_VR-Chain
  source 1..432: mol_type = other RNA
gagctgcagctggtggagagcggcggcggcctggtgcagcccggctggagcctgagactgagctgcgaggccagcggcttccccttcagcgccttctggatgacctgggtgagacaggcccccggcaagggcctgggctgggtggccttcatcagatacgacggcagcaacaagtactacgccgacagcgtgaagggcagattcaccatcagcagagacaacagcatgaccaccctgtacctgcagatgaacagcctgagagccgaggacgccgccgtgtactactgcgccaaggacctgagagaggacgagtgcgaggagtggtggagcgactactacgacttcggcaagagactgccctgcagaaagagcagaggcgtggccggcgtgttcgacaagtggggccagggcaccatggtgaccgtgagcagc

SEQ ID NO: 32356 - RNA, 432 nt, synthetic construct
  misc_feature 1..432: note = derived and/or modified sequence opt4 from anti-HIV_cap256-119-147434_VR-Chain
  source 1..432: mol_type = other RNA
caggtgcagctggtggagagcggcggcggcgtggtgcaggccggcagaagcctgagactgagctgcgccgccagccagttcaccttcggcagatacggcatgcactgggtgagacaggcccccggcaagggcctggagtgggtgggcagcatcagctacgacggcagcgacaagtaccacaccaacagcgtgtggggcagattcatcgtgagcagagacaacagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32357 - RNA, 435 nt, synthetic construct
  misc_feature 1..435: note = derived and/or modified sequence opt4 from anti-HIV_cap256-119-146106_VR-Chain
  source 1..435: mol_type = other RNA
caggtgcagctggtggagagcggcggcggcgtggtgcagcccggcagaagcctgagactgagctgcgccgccagcggcttcaccttcagcagcagcggcatgcactgggtgagacaggcccccggcaagggcctgcagtgggtggccgtgatcagctacgacggcggcaacaagtactacgccgacagcgtgaagggcagattcaccatcagcagagacaacagcaagaacaacctgtacctgcagatgaacagcctgagacccgaggacaccgccctgtactactgcgccagagacctgagagagatggagtgcgaggagtggaagctgtacaactactacgacttcagaaccagaggcccctgcgtggaccccagaggcgtggtgggcagcttcgacgtgtggggccagggcaccgtggtgaccgtgagcagc

SEQ ID NO: 32358 - RNA, 438 nt, synthetic construct
  misc_feature 1..438: note = derived and/or modified sequence opt4 from anti-HIV_cap256-119-145604_VR-Chain
  source 1..438: mol_type = other RNA
gacgtgcagctggccgagagcggcggcggcctggtgcagcccggcggcagcctgagactgagctgcgtggccagcggcttcaccttcagcagcttcgagatgcactgggtgagacaggcccccggcaagggcctggagtgggtggccagcatcagcaacgacggcaccaagagataccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32359 - RNA, 438 nt, synthetic construct
  misc_feature 1..438: note = derived and/or modified sequence opt4 from anti-HIV_cap256-119-143998_VR-Chain
  source 1..438: mol_type = other RNA
caggtgcagctggtggagagcggcggcggcgtggtgcagcccggcagaagcctgagactgagctgcgccgccagcggcttcaccttcagaaactacggcatgcactgggtgagacaggcccccggcaagggcctggagtgggtggccagcatcagcaacgacggcagcaagaagtaccacggcgacagcgtgtgggccagattcatcatcagcagagacaacagcaagaacaccctgttcctgcagatgagcagcctgagagccgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32360 - RNA, 438 nt, synthetic construct
  misc_feature 1..438: note = derived and/or modified sequence opt4 from anti-HIV_cap256-119-143441_VR-Chain
  source 1..438: mol_type = other RNA
gaggtgcacctggtggagagcggcggcggcctggcccagcccggcagaagcctgagactgagctgcgccgccagccagttcaacttcgccagctacggcatgcactgggtgagacaggcccccggcaagggcctggagtgggtggccagcatcagcaacgacggcaccaagagataccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32361 - RNA, 432 nt, synthetic construct
  misc_feature 1..432: note = derived and/or modified sequence opt4 from anti-HIV_cap256-119-141307_VR-Chain
  source 1..432: mol_type = other RNA
caggtgcacctggtggagagcggcggcggcgtggtgcagcccggcagaagcctgagactgagctgcgccgccagccagttcaccttcaacagatacggcctgcactgggtgagacaggcccccggcaagggcctggagtgggtggccggcatcagctacgacggcagagacaagtaccacgcccacttcgtgtggggcagattcatcatcagcagagacaacagcaagaacaccctgtacctgcagatgaacagcctgagagccgaggacaccgccctgtactactgcgtgagagacctgagagagagcgagtgcgagctgtgggagagcgactactacgacttcggcaagagactgccctgcgtgaagcccagaggcgtggccggcaccttcgacctgtggggccagggcaccatggtgaccgtgagcagc

SEQ ID NO: 32362 - RNA, 432 nt, synthetic construct
  misc_feature 1..432: note = derived and/or modified sequence opt4 from anti-HIV_cap256-119-140896_VR-Chain
  source 1..432: mol_type = other RNA
gaggtgaagctggtggagagcggcggcggcctggtgcagcccggcggcagcctgaagctgagctgcgccgccagcggcttcaccttcagctactacgccatgcactgggtgagacaggcccccggcaagggcctggagtgggtggccgtgatcagctacgacggcagcgacaagtactacgccgacagcgtgaagggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32363 - RNA, 432 nt, synthetic construct
  misc_feature 1..432: note = derived and/or modified sequence opt4 from anti-HIV_cap256-119-140090_VR-Chain
  source 1..432: mol_type = other RNA
gaggtgcagctggtggagagcggcggcggcctggtgcagcccggcggcagcctgagactgagctgcgccgccagcggcttcgccttcagcagctactggatgacctgggtgagacaggcccccggcaagggcctggagtgggtggccgtgatcagctacgacggcagcaacaagtactacgccgacagcgtgagaggcagattcaccatcagcagagacagcagcaagaacaccctgtacctggagatgaacagcctgagacccgaggacaccgccctgtactactgcgccaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32364 - RNA, 438 nt, synthetic construct
  misc_feature 1..438: note = derived and/or modified sequence opt4 from anti-HIV_cap256-119-140037_VR-Chain
  source 1..438: mol_type = other RNA
caggtgcagctggtggagagcggcggcggcctggtgcagcccggcagaagcctgagactgagctgcgccgccagcggcttcaccttcgacgactacgtgatgcactgggtgagacaggcccccggcaagggcctggagtgggtggccagcatcagcaacgacggcaccaagaagtaccacgaggagagcgtgtggggcagattcaccatcagcaaggacaacagcaagagcaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32365 - RNA, 432 nt, synthetic construct
  misc_feature 1..432: note = derived and/or modified sequence opt4 from anti-HIV_cap256-119-139135_VR-Chain
  source 1..432: mol_type = other RNA
gaggtgcagctggtggagagcggcggcggcgtggtgagacccggcggcagcgtgagactgagctgcgtggccagcggcttcagcttcagaagctacggcatgcactgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32366 - RNA, 438 nt, synthetic construct
  misc_feature 1..438: note = derived and/or modified sequence opt4 from anti-HIV_cap256-119-137881_VR-Chain
  source 1..438: mol_type = other RNA
caggtgcagctggtggagagcggcggcggcctggtgaagcccggcagaagcctgaccctgagctgcgccgccagccagttcaccttcagcaactacggcatgcactgggtgagacaggcccccggcaagggcctggagtgggtggccagcatcagcaacgacggcaacaagaagtaccacggcgacagcgtgtgggccagattcaccatcagcagagacaacagcaagaacaccctgttcctgcagatgagcagcctgagaaccgaggacaccgccctgtacttctgcgtgagagacagaagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32367 - RNA, 432 nt, synthetic construct
  misc_feature 1..432: note = derived and/or modified sequence opt4 from anti-HIV_cap256-119-137643_VR-Chain
  source 1..432: mol_type = other RNA
gaggtgcagctggtggagagcggcggcgacctggtgcagcccggcggcagcctgagactgagctgcgccgccagcggcttcagcttcagcagctacggcatgcactgggtgagacaggcccccgacaagggcctggagtgggtgaccgtgatcagctacgacggcagcaacaagcactacgccgacagcgtgaagggcagattcaccatcagcagagacaacagcaagaacaccctgtacctggagatgaacaccctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgagcgtgagcagc

SEQ ID NO: 32368 - RNA, 438 nt, synthetic construct
  misc_feature 1..438: note = derived and/or modified sequence opt4 from anti-HIV_cap256-119-137170_VR-Chain
  source 1..438: mol_type = other RNA
caggtgcagctggtggagagcggcggcggcgtggtgcagcccggcagaagcctgagactgagctgcgccgccagcgagttcaccttcagcagatacagcatgcactgggtgagacaggcccccggcaagggcctggagtgggtggccgtgatcagcagcgacggcagcaaccagttccacgccgacagcgtgtggggcagattcaccatcagcaaggacaacagcaagaacaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32369 - RNA, 432 nt, synthetic construct
  misc_feature 1..432: note = derived and/or modified sequence opt4 from anti-HIV_cap256-119-136616_VR-Chain
  source 1..432: mol_type = other RNA
caggtgcagctggtggagagcggcggcggcgtggtgcagcccggcagaagcctgagactgagctgcgccgccagcggcttcaccttcagcagaaacgccatcaactgggtgagacaggcccccggcagaggcctggagtgggtggccgtgatcagcgacgacggcagcctgaagtactacgccgacagcgtgaagggcagattcaccatcagcagagacaacagcaagaacaccctgtacctgcagatgaacaacctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32370 - RNA, 432 nt, synthetic construct
  misc_feature 1..432: note = derived and/or modified sequence opt4 from anti-HIV_cap256-119-136206_VR-Chain
  source 1..432: mol_type = other RNA
caggtgcagctggtggagagcggcggcggcgtggtgcagcccggcagaagcctgagactgagctgcgccgccagccagttcaccttcggcagatacggcatgcactgggtgagacaggcccccggcaagggcctggagtgggtggccgccatcagcttcgccggcaccaagaagtactacggcgacagcgccagaggcagattcaccatcagcagagacaacagcaagaacatgctgttcctgcagatgaacagcctgagagccgaggacaccgccctgtactactgcgccagagacctgagagactacgagtgcgaggagtgggaggcctactactacgacttcggcagagtgggcccctgcaccgaccccagaggcgtggtgggcatcctggacgtgtggggccagggcaccctggtgaccgtgagcagc

SEQ ID NO: 32371 - RNA, 438 nt, synthetic construct
  misc_feature 1..438: note = derived and/or modified sequence opt4 from anti-HIV_cap256-119-135565_VR-Chain
  source 1..438: mol_type = other RNA
caggtgcacctggtggagagcggcggcggcgtggtgcagcccggcaagagcctgagactgagctgcgccgccagccagttcaccttcgacagatacggcatgcactgggtgagacaggcccccggcaagggcctggagtgggtggccagcatcagcaacgacggcaccgacaagtaccacgccgacaacgtgtggggcagattcaccatcagcagagacaacagcaagaacaccctgtacctggagatgaacagcctgagaggcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32372 - RNA, 432 nt, synthetic construct
  misc_feature 1..432: note = derived and/or modified sequence opt4 from anti-HIV_cap256-119-135025_VR-Chain
  source 1..432: mol_type = other RNA
gaggtgcagctggtggagagcggcggcggcctggtgcagcccggcggcagcctgagactgagctgcgaggccagcggcttcaccttcaacacctacgagatgaactgggtgagacagccccccggcagaggcctggagtgggtggccggcatcagcttcgccgccaccaagacctactacggcggcagcgtgaagggcagattcaccgtgagcagagacatcagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32373 - RNA, 432 nt, synthetic construct
  misc_feature 1..432: note = derived and/or modified sequence opt4 from anti-HIV_cap256-119-133983_VR-Chain
  source 1..432: mol_type = other RNA
cagatgcagctggtggagagcggcggcggcgtggtgcagcccggcagaagcctgaccctgagctgcgccgccagccagttcaacttcgccaactacggcatgcactgggtgagacaggcccccggcaagggcctggagtgggtggccagcatcagcaacgacggcaccaagaagtaccacgaggagagcgtgtggggcagattcaccatcagcaaggacaacagcaagaacaccctgttcctgcagatgaacagcctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32374 - RNA, 438 nt, synthetic construct
  misc_feature 1..438: note = derived and/or modified sequence opt4 from anti-HIV_cap256-119-133917_VR-Chain
  source 1..438: mol_type = other RNA
cagatgcagctggtggagagcggcggcggcgtggtgcagcccggcagaagcctgaccctgagctgcgccgccagccagttcaccttcagcaactacggcatgcactgggtgagacaggcccccggcaagggcctggagtgggtggccagcatcagcaacgacggcagcaagaagtaccacggcgacagcgtgtgggccagattcaccatcagcagagacaacagcaagaacaccctgttcctgcagatgagcagcctgagagtggaggacaccgccctgtacttctgcgtgagagaccagagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32375 - RNA, 432 nt, synthetic construct
  misc_feature 1..432: note = derived and/or modified sequence opt4 from anti-HIV_cap256-119-132663_VR-Chain
  source 1..432: mol_type = other RNA
caggcccagctggtggagagcggcggcggcgtggtgcagcccggcagaagcctgagaatcagctgcgccgtgagccagttcaccttcagcagatacggcatgcactgggtgagacaggcccccggcaagggcctggagtgggtggccagcatcagcttcgacggcagagacaagtaccacagccccctggtgtggggcagactgaccatcagcagagacaacagcaagaacaccctgttcctggagatgaacagcctgagagccgaggacaccgccgtgtactactgcgccagagacctgagagagagcgagtgcgaggagtggcagagcgactactacgccttctacaagaagctgccctgcgtgaagcccagaggcgtggccggcagcctggacatctggggccagggcaccgtggtgaccgtgagcagc

SEQ ID NO: 32376 - RNA, 438 nt, synthetic construct
  misc_feature 1..438: note = derived and/or modified sequence opt4 from anti-HIV_cap256-119-132113_VR-Chain
  source 1..438: mol_type = other RNA
caggtgcagctggtggagagcggcggcggcctggtgaagcccggcggcagcctgagactgagctgcgccgccagccagttcaacttcgccaactacggcatgcactgggtgagacaggcccccggcaagggcctggagtgggtggccagcatcagcaacgacggcaccaagaagtaccacgaggagagcgtgtggggcagattcaccatcagcaaggacaacagcaagagcaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32377 - RNA, 432 nt, synthetic construct
  misc_feature 1..432: note = derived and/or modified sequence opt4 from anti-HIV_cap256-119-131839_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32378 - RNA, 435 nt, synthetic construct
  misc_feature 1..435: note = derived and/or modified sequence opt4 from anti-HIV_cap256-119-130626_VR-Chain
  source 1..435: mol_type = other RNA
gaggtgcagctggtggagagcggcggcggcctgatccaccccggcggctgcctgagactgagctgcgccgtgagcggcttcaccttcagcgactaccccatgcactgggtgagacagagccccggcaagggcctggagtgggtggccgtgatcagctacgacggcatcaactactactacgccgacagcgtgaagggcagattcaccatcagcagagacaacagcaagaacaacctgttcctgcagatgaacagcctgagactggaggacaccgccctgtactactgcgccagagacctgagagagctggactgcgaggagtggaccctgtacaactactacgacttcggcagcagaggcccctgcgtggaccccagaggcgtgggcggcagcttcgacgtgtggggccagggcaccatggtgaccgtgagcagc

SEQ ID NO: 32379 - RNA, 438 nt, synthetic construct
  misc_feature 1..438: note = derived and/or modified sequence opt4 from anti-HIV_cap256-119-130191_VR-Chain
  source 1..438: mol_type = other RNA
gaggtgcagctggtggagagcggcggcggcctgatccagcccggcagaagcctgagactgagctgcgccgccagcggcttcaccgtgagcagcaacttcatgacctgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32380 - RNA, 438 nt, synthetic construct
  misc_feature 1..438: note = derived and/or modified sequence opt4 from anti-HIV_cap256-119-129798_VR-Chain
  source 1..438: mol_type = other RNA
caggtgcagctggtggagagcggcggcggcgtggtgcagcccggcaagagcctgagactgagctgcgccgccagcggcttcatcttcagcagctacttcatgcactgggtgagacaggcccccggcaagggcctggagtgggtggccgtggtgaccgacgacggcagcaagaagtactacgccgacagcgtgaagggcagattcaccatcagcagagactacagcaagaacaccctgttcctgcagatgaacagactgagagtggaggacaccgccctgtacttctgcgtgaaggaccagagagaggacgagtgcgaggagtggtggagcgactactacgacttcggcagagagctgccctgcagaaagttcagaggcctgggcctggccggcatcttcgacatgtggggccacggcaccatggtgaccgtgagcagc

SEQ ID NO: 32381 - RNA, 432 nt, synthetic construct
  misc_feature 1..432: note = derived and/or modified sequence opt4 from anti-HIV_cap256-119-128745_VR-Chain
  source 1..432: mol_type = other RNA
caggtgcagctggtggagagcggcggcggcgtggtgcagcccggcagaagcctgagactgagctgcgccgccagcggcttcaccttcagcaactacgccatgcactgggtgagacaggcccccggcaagggcctggagtgggtggccagcatcagcttcgccggcaccaagacccactacggcaacagcgtgaagggcagattcagcatcagcagagacaacagcatcaacaccgtgtacctgcagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32382 - RNA, 438 nt, synthetic construct
  misc_feature 1..438: note = derived and/or modified sequence opt4 from anti-HIV_cap256-119-128593_VR-Chain
  source 1..438: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatctggggccacggcaccatggtgaccgtgagcagc

SEQ ID NO: 32383 - RNA, 438 nt, synthetic construct
  misc_feature 1..438: note = derived and/or modified sequence opt4 from anti-HIV_cap256-119-128152_VR-Chain
  source 1..438: mol_type = other RNA
caggtgcagctggtggagagcggcggcggcgtggtgcagcccggcagaagcctgagactgagctgcgccgtgagcggcttcaccttcaccagctaccccatgcactgggtgagacaggcccccggcaagggcctggagtgggtggccagcgtgagcaacgacggcaccaagaagtaccacggcgacagcgtgtgggacagattcaccatcagcagagacaacagcaagaacaccctgttcctgcagatgagcagcctgagagccgaggacaccgccgtgtacttctgcgtgagagacgagagagaggacgagtgcgaggagtggtggagcgactactacgacttcggcagagagctgccctgcagaaagttcagaggcctgggcctggccggcatcttcgacatctggggccacggcaccctggtgaccgtgagcagc

SEQ ID NO: 32384 - RNA, 438 nt, synthetic construct
  misc_feature 1..438: note = derived and/or modified sequence opt4 from anti-HIV_cap256-119-127693_VR-Chain
  source 1..438: mol_type = other RNA
gaggtgcagctgctggagagcggcggcggcctggtgcagcccggcggcagcctgagactgagctgcgccgccagcggcttcaccttcagcagctacgccatggcctgggtgagacaggcccccggcaagggcctggagtgggtggccagcatcagcaacgacggcagcaagaagtaccacggcgacagcgtgtgggccagattcatcatcagcagagacaacagcaagaacaccctgttcctgcagatgagcagcctgagagtggaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32385 - RNA, 432 nt, synthetic construct
  misc_feature 1..432: note = derived and/or modified sequence opt4 from anti-HIV_cap256-119-126684_VR-Chain
  source 1..432: mol_type = other RNA
caggtgcagctggtggagagcggcggcggcgccgtgagacccggcagaagcctgagactgagctgcgccaccagcggcttcaccttcagcaactacgccatgcactgggtgagacaggcccccggcaagggcctggagtgggtgaccggcatcagcttcgccggcaccaagacctactacggcgacagcgtgagaggcagattcaccgtgagcagagacatcagcaagaacaccctgttcctgcagatgaacagcctgagacccgacgacaccgccatgtactactgcgccagagaccagagatactacgagtgcgaggagtgggccagcgactactacgacttcggcagagagcagccctgcctggaccccagaggcgtggtgggcatcttcgacctgtggggccagggcaccatggtgaccgtgagcagc

SEQ ID NO: 32386 - RNA, 438 nt, synthetic construct
  misc_feature 1..438: note = derived and/or modified sequence opt4 from anti-HIV_cap256-119-126056_VR-Chain
  source 1..438: mol_type = other RNA
gaggtgcagctggtggagagcggcggcggcctggtgcagcccggcggcagcctgagactgagctgcgccgacagcggcttcaccttcagcagctactggatgagctgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32387 - RNA, 432 nt, synthetic construct
  misc_feature 1..432: note = derived and/or modified sequence opt4 from anti-HIV_cap256-119-125765_VR-Chain
  source 1..432: mol_type = other RNA
caggtgcagctggtgcagagcggcggcggcgtggtgcagcccggcagaagcctgagactgagctgcgccgccagcggcttcaccttcagcagctacgtgatgcactgggtgagacaggcccccggcaagggcctggagggcgtggccgtgatcagcttcgacggcaacaacgagtactacgccgacagcgtgaagggcagattcaccatcagcagagacaacagcaagaacaccgtgtacctgcagatgaacagcctgagagtggaggacaccgccctgtactactgcgccaaggacatgagagagtacgagtgcgaggagtggaccagcgactactacgacttcggcagaccccagccctgcatcgacagcagaggcgtggtgggcatcctggacatctggggccagggcatcatggtgaccgtgagcagc

SEQ ID NO: 32388 - RNA, 438 nt, synthetic construct
  misc_feature 1..438: note = derived and/or modified sequence opt4 from anti-HIV_cap256-119-125106_VR-Chain
  source 1..438: mol_type = other RNA
caggtgcagctggtggagagcggcggcggcgtggtgcagcccggcagaagcctgagactgagctgcgccgccagcggcttcatcttcagaagctacggcatgcactgggtgagacaggcccccggcaagggcctggagtgggtggccagcatcagcaacgacggcaccaagagataccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32389 - RNA, 435 nt, synthetic construct
  misc_feature 1..435: note = derived and/or modified sequence opt4 from anti-HIV_cap256-119-124026_VR-Chain
  source 1..435: mol_type = other RNA
caggtgcagctggtggagagcggcggcggcgtggtgcagagcggcagaagcctgagactgacctgcagcggcagcgccttcagattcagcagctacaccgtgcactgggtgagacaggcccccggcaagggcctggagtggctggccctgatcagctacgacggccagaagaagcacttcgccgacagcgtgaagggcagattcaccatcagcagagacaacagcaagaacaacctgttcctgcagatgaacagcctgagactggaggacaccgccctgtactactgcgccagagacctgagagagctggactgcgaggagtggaccctgtacaactactacgacttcggcagcagaggcccctgcgtggaccccagaggcgtgggcggcagcttcgacgtgtggggccagggcaccatggtgaccgtgagcagc

SEQ ID NO: 32390 - RNA, 432 nt, synthetic construct
  misc_feature 1..432: note = derived and/or modified sequence opt4 from anti-HIV_cap256-119-121783_VR-Chain
  source 1..432: mol_type = other RNA
ctgggcagactggtggccagcggcggcggcgtggtgccccccggcggcagcctgaccctgagctgcgtgaccagccagttcaccttcagcggctgcggcctgcactgggtgagacaggcccccggcaagggcctggagtgggtggccagcatcagcttcgccggcaccaagaagcactacggcagcagcgtgagaggcagattcagcatcagcagagacaacagcaagaacaccctgtacctgcagatgaacagcctgagaaccgaggacaccgccctgtacttctgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32391 - RNA, 432 nt, synthetic construct
  misc_feature 1..432: note = derived and/or modified sequence opt4 from anti-HIV_cap256-119-121208_VR-Chain
  source 1..432: mol_type = other RNA
ctgggcagactggtggccagcggcggcggcgtggtgccccccggcaagagcctgaccctgagctgcgtggccagccagttcaccttcagcggctgcggcctgcactgggtgagacaggcccccggcaagggcctggagtgggtggccagcatcagcttcgccggcaccaagaagcactacggcaacttcgtgagaggcagattcaccatcagcagagacaacagcaagaacaccctgtacctgcagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32392 - RNA, 432 nt, synthetic construct
  misc_feature 1..432: note = derived and/or modified sequence opt4 from anti-HIV_cap256-119-120945_VR-Chain
  source 1..432: mol_type = other RNA
caggtgcagctggtggagagcggcggcggcgtggtgcagcccggcggcagcctgagactgagctgcgtggccagcggcttcaccttcagcaactacggcatgcactgggtgagacaggcccccggcaagggcctggcctgggtggccttcatcagatacgacggcagcaacaagtactacgtggacagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaacaagggcccctgcgtgaagcccagaggcgtggtgggcgtgctggacatctggggccagggcaccctggtgaccgtgagcagc

SEQ ID NO: 32393 - RNA, 432 nt, synthetic construct
  misc_feature 1..432: note = derived and/or modified sequence opt4 from anti-HIV_cap256-119-118229_VR-Chain
  source 1..432: mol_type = other RNA
caggtgcaggtggtggagagcggcggcggcgtggtgcagcccggcagaagcctgagactgagctgcgccgccagcggcttcaccttcagcaactacgccatccactgggtgagacaggcccccggcaagggcctggagtgggtggccctgatcagctacgacggctacaacaagtactacgccgacagcgtgagaggcagattcaccatcagcagagacaacagcaacaacaccgtgtacctgcagatgaacagcctgaagcccgaggacaccgccgtgtactactgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32394 - RNA, 432 nt, synthetic construct
  misc_feature 1..432: note = derived and/or modified sequence opt4 from anti-HIV_cap256-119-118025_VR-Chain
  source 1..432: mol_type = other RNA
gaggtgcagctggtggagagcggcggcggcgtggtgcagcccggcaagagcctgagactgagctgcaccgccagccagttcaccttcagcaacttcggcatgcactgggtgagacaggcccccggcaagggcctggagtgggtggccagcatcagcttcgtgggcatcaagacccactacgccaacagcgtgagaggcagattcaccatcagcagagaccagagcaagaacaccctgtacctgcagatgaacagcgtgagaatcgaggacaccgccagatacttctgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32395 - RNA, 432 nt, synthetic construct
  misc_feature 1..432: note = derived and/or modified sequence opt4 from anti-HIV_cap256-119-117418_VR-Chain
  source 1..432: mol_type = other RNA
caggtgcagctggtggagagcggcggcggcgtggtgcagcccggcagaagcctgagactgagctgcgccgccagcggcttcaacttcagaaactacgacatcaactgggtgagacaggtgcccggcaagggcctggagtgggtggccgccatcagcttcgacggcgccgacaagtaccacgccgacaacgtgtggggcagactgagcatcagcagagacaacagcaagagcaccctgtacctgcagatgaacagcctgagacccgaggacaccgccgtgtacttctgcgccaaggacctgagagaggacgagtgcgaggagagatggagcgactactacgacttcggcaagcagctgccctgcagaaagagcagaggcgtggccggcatcttcgacaactggggccagggcaccatggtgaccgtgagcgcc

SEQ ID NO: 32396 - RNA, 432 nt, synthetic construct
  misc_feature 1..432: note = derived and/or modified sequence opt4 from anti-HIV_cap256-119-117250_VR-Chain
  source 1..432: mol_type = other RNA
caggtgagactggtggagagcggcggcggcgtggtgcagcccggcggcagcctgagactgagctgcgccgccagccagttcaccttcagcgcctacggcatgcactgggtgagacaggcccccggcaagggcctggagtgggtggccagcatcagcttcgacggcaccgacaagttccacgccgacaaggtgtggggcagactggtgatcagcagagacaacagcaagaacaccctgtacctgcagatgaacagcctgagacccgaggacaccgccgtgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32397 - RNA, 432 nt, synthetic construct
  misc_feature 1..432: note = derived and/or modified sequence opt4 from anti-HIV_cap256-119-117230_VR-Chain
  source 1..432: mol_type = other RNA
caggtgcagctggtggagagcggcggcggcggcgtgcagcccggcagaagcctgagactgagctgcgccgccagcggcttcaccctgagcagctacggcatgcactgggtgagacaggcccccggcaagggcctggagtgggtggccagcatcagcttcgacggcagagactactaccacagcccccacgtgtggggcagactgaccatcagcagagacaacagcaagaacaccctgtacctgcagatgaacagcctgagagccgaggacaccgccctgtactactgcgccagagacctgagagagagcgagtgcgaggagtgggagagcgactactacgacttcggcaagaagggcccctgcgtgaagcccagaggcgtggccggcagcctggacatgtggggccagggcaccatggtgatcgtgagcagc

SEQ ID NO: 32398 - RNA, 432 nt, synthetic construct
  misc_feature 1..432: note = derived and/or modified sequence opt4 from anti-HIV_cap256-119-116999_VR-Chain
  source 1..432: mol_type = other RNA
caggtgcagctggtggagagcggcggcggcgtggtgcagcccggcaccagcctgagaatcagctgcgccgccagccagttcaccttcagcagatacggcatgcactgggtgagacaggcccccggcaagggcctggagtgggtggccagcatcagctacgacggcagagactactaccacgccggcagagtgtggggcagattcaccatcagcagagacaacagcaagaacaccctgtacctgcagatgaacagcctgagacccgaggacaccgccctgtacttctgcgtgagagacagcagagagagcgagtgcgaggagtgggagagcgactactacgacttcggcaagaagctgccctgcgtgaagcccagaggcgtggtgggcgtgctggacctgtggggccagggcaccctggtgaccgtgagcagc

SEQ ID NO: 32399 - RNA, 432 nt, synthetic construct
  misc_feature 1..432: note = derived and/or modified sequence opt4 from anti-HIV_cap256-119-116558_VR-Chain
  source 1..432: mol_type = other RNA
caggtgcagctggtggagagcggcggcggcgtggtgcagcccggcagaagcctgagactgagctgcgccgccagcggcttcaccttcaacagatacagcctgcactgggtgagacaggcccccggcaagggcctggagtgggtggccttcaccagctacgacggcagcaacaagtactaccccgacagcgtgaagggcagattcaccatcagcagagacagcagcaagaacaccctgtacctggagatgaacagcctgagacccgaggacaccgccctgtactactgcgccaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32400 - RNA, 432 nt, synthetic construct
  misc_feature 1..432: note = derived and/or modified sequence opt4 from anti-HIV_cap256-119-116484_VR-Chain
  source 1..432: mol_type = other RNA
gacgtgcagctgctggagagcggcggcgacctggtgcagcccggcggcagcctgagactgagctgcgccgccagcggcttcaccttcaccaagtacgagatgacctgggtgagacaggcccccggcaagggcctggagtgggtggccagcatcagctacgacggcagcgacaagtaccacaccagcagcctgtggggcagattcatcgtgagcagagacaacagcaagaacaccctgtacctgcagatgaacagcctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32401 - RNA, 438 nt, synthetic construct
  misc_feature 1..438: note = derived and/or modified sequence opt4 from anti-HIV_cap256-119-114844_VR-Chain
  source 1..438: mol_type = other RNA
gaggtgcagctggtggagagcggcggcgacctggtgcagcccggcagaagcctgagactgagctgcgccgccagcggcttcaccttcagcagctactggatgagctgggtgagacaggcccccggcaagggcctggagtgggtggccagcatcagcaacgacggcaccaagaagtaccacgaggagagcgtgtggggcagattcaccatcagcaaggacaacagcaagagcaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32402 - RNA, 438 nt, synthetic construct
  misc_feature 1..438: note = derived and/or modified sequence opt4 from anti-HIV_cap256-119-114141_VR-Chain
  source 1..438: mol_type = other RNA
ggcggcagaagcggcggcggcggcgtgggcaccacccccagaagaggccccctgagactgagctgcgccgccagcggcttcaccctggacgactacgccatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgtgttctgggagagagccccctgcagaaccgtgcccggcagaggccccggctggtacttcgacatggtgggcagaagaaccatggtgaccgtgagcagc

SEQ ID NO: 32403 - RNA, 432 nt, synthetic construct
  misc_feature 1..432: note = derived and/or modified sequence opt4 from anti-HIV_cap256-119-111917_VR-Chain
  source 1..432: mol_type = other RNA
gaggtgcacctggtggagagcggcggcggcctggtgcagcccggcggcagcctgagactgagctgcgccgccagcggcttcaccttcagcagctacggcatgcactgggtgagacaggcccccggcaagggcctggagtgggtggccaccatcagcttcgacggcgccgacaagtaccacgccgacgacgtgtggggcagattcagcatcagcagagacaacagcaagaacaccctgtacctgcagatgaacaacctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32404 - RNA, 432 nt, synthetic construct
  misc_feature 1..432: note = derived and/or modified sequence opt4 from anti-HIV_cap256-119-111862_VR-Chain
  source 1..432: mol_type = other RNA
caggtgcagctggtggagagcggcggcggcgtggtgcagcccggcggcagcctgagactgagctgcgccgccagcggcttcacctacagcgactacggcatgcactgggtgagacaggcccccggcaagggcctggagtgggtggccagcatcagcttcgccggcaccaagcagcactacggcaacagcgtgaagggcagattcaccatcagcagagacaacagcaagaacaccgtgtacctgcagatgaacagcctgagagtggaggacaccgccctgtactactgcgccaaggacatgagagagtacgagtgcgaggagtggaccagcgactactacgacttcggcagaccccagccctgcatcgacagcagaggcgtggtgggcatcctggacatctggggccagggcatcatggtgaccgtgagcagc

SEQ ID NO: 32405 - RNA, 432 nt, synthetic construct
  misc_feature 1..432: note = derived and/or modified sequence opt4 from anti-HIV_cap256-119-110064_VR-Chain
  source 1..432: mol_type = other RNA
ctgggcagactggtggccagcggcggcggcgtggtgccccccggcagaagcctgagactgagctgcgtggccagccagttcaccttcagcggctgcggcctgcactgggtgagacaggcccccggcaagggcctggagtgggtggccagcatcagcttcgccggcaccaagcagcactacggcaacagcgtgaagggcagattcaccatcagcagagacaacagcaagaacaccgtgtacctgcagatgaacagcctgagagtggaggacaccgccctgtactactgcgccaaggacatgagagagtacgagtgcgaggagtggaccagcgactactacgacttcggcagaccccagccctgcatcgacagcagaggcgtggtgggcatcctggacatctggggccagggcaccatggtgaccgtgagcttc

SEQ ID NO: 32406 - RNA, 432 nt, synthetic construct
  misc_feature 1..432: note = derived and/or modified sequence opt4 from anti-HIV_cap256-119-109192_VR-Chain
  source 1..432: mol_type = other RNA
caggtgcagctggtggagagcggcggcggcgtggtgcagcccggcagaagcctgagactgagctgcgccgccagcggcttcaccttcagcaactacgccatgcactgggtgagacaggcccccggcaagggcctggagtgggtggccgtgatcgcctacgacggcgacaacaagtactacgccgacagcgtgaagggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacctgggcaagcagctgccctgcagaaagagcagaggcgtggccggcgtgctggacaagtggggcctgggcaccatggtgaccgtgagcagc

SEQ ID NO: 32407 - RNA, 435 nt, synthetic construct
  misc_feature 1..435: note = derived and/or modified sequence opt4 from anti-HIV_cap256-119-108793_VR-Chain
  source 1..435: mol_type = other RNA
cagttccagctggtggagagcggcggcggcgtggtgcagcccggcagaagcctgagactgagctgcgccgccagcggcttcaccttcagcagctaccccatgcactgggtgagacaggcccccggcaagggcctggagtgggtggccctgatcagctacgacggcaccgacaagtactacgccgacagcgtgaagggcagattcaccatcagcagagacaacagcaagaacaccctgtacctgcagatgaacagcctgagagtggaggacaccgccgtgtaccactgcgccaaggacctgggcggcagcaagagcgacgagtgggccaccgactactactacgactggagcaaggcctaccccgtgcacgaccccagagccgtggtgggcgtgttcgacatctggggccagggcaccctggtgaccgtgagcagc

SEQ ID NO: 32408 - RNA, 432 nt, synthetic construct
  misc_feature 1..432: note = derived and/or modified sequence opt4 from anti-HIV_cap256-119-108127_VR-Chain
  source 1..432: mol_type = other RNA
caggtgcagctggtggagagcggcggcggcgtggtgcagcccggcagaagcctgagaatcagctgcgccgccagccagttcaccttcaacagatacggcatgcactgggtgagacaggcccccggcaagggcctggagtgggtggccagcatcagctacgacggcagcgacaagtaccacgccggcctggtgtggggcagattcatcatcagcagagacaacagcaagaacaccctgtacctgcagatgaacagcctgagagccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32409 - RNA, 438 nt, synthetic construct
  misc_feature 1..438: note = derived and/or modified sequence opt4 from anti-HIV_cap256-119-107758_VR-Chain
  source 1..438: mol_type = other RNA
gaggtgcagctggtggagagcggcggcggcctggtgaagcccggcggcagcctgagactgagctgcgccgccagcggcttcaccttcagcaacgcctggatgagctgggtgagacaggcccccggcaagggcctggagtgggtggccagcatcagcaacgacggcaccaagaagtaccacgaggagagcgtgtggggcagattcaccatcagcaaggacaacagcaagaacaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32410 - RNA, 432 nt, synthetic construct
  misc_feature 1..432: note = derived and/or modified sequence opt4 from anti-HIV_cap256-119-107209_VR-Chain
  source 1..432: mol_type = other RNA
gaggtgcagctggtggagagcggcggcggcctggtgcagcccggcagaagcctgagactgagctgcaccgccagcggcttcaccttcggcgactacggcatgcactgggtgagacaggcccccggcaagggcctggagtgggtggccgccatcagcttcgacggcgccgacaagtaccacgccgacaacgtgtggggcagactgagcatcagcagagacaacagcaagagcaccctgtacctgcagatgaacagcctgagacccgaggacaccgccgtgtacttctgcgccaaggacctgagagaggacgagtgcgaggagagatggagcgactactacgacttcggcaagcagctgccctgcagaaagagcagaggcgtggccggcatcttcgacaactggggccagggcaccatggtgaccgtgagcgcc

SEQ ID NO: 32411 - RNA, 432 nt, synthetic construct
  misc_feature 1..432: note = derived and/or modified sequence opt4 from anti-HIV_cap256-119-107184_VR-Chain
  source 1..432: mol_type = other RNA
caggcccagctggtggagagcggcggcggcgtggtgcagcccggcagaagcctgggcctgagctgcgccgccagcaagttcagcctgagcagctacggcatgcactgggtgagacaggcccccggcagaggcctggagtgggtggccggcatcagcttcgccggcaccaagaagtactacgccgacagcgtgagaggcagattcagcgtgagcaccgacatcagcaagaacaccctgtacctgcagatgaacagcctgagacccgccgacaccgccctgtacttctgcgccagagacctgagatactacgagtgcgaggagtgggccagcgactactacgacttcggcaaggagcagccctgcctggaccccagaggcgtggtgggcatcttcgacctgtggggccagggcaccatggtgaccgtgagcagc

SEQ ID NO: 32412 - RNA, 438 nt, synthetic construct
  misc_feature 1..438: note = derived and/or modified sequence opt4 from anti-HIV_cap256-119-106827_VR-Chain
  source 1..438: mol_type = other RNA
gccgtgcagctggtggagagcggcggcggcctggtgcagcccggcggcagcctgagactgagctgcagcgtgagccagttcaccttcggcagatacggcatgtactgggtgagacaggcccccggcaagggcctggagtgggtggccgtgatcagctacgacggcggcaacagatactacgccgacagcgtgaagaacagattcagcatcagcagagacaacagcaagaacaccctgttcctgcagatgagcagcctgagagccgaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32413 - RNA, 432 nt, synthetic construct
  misc_feature 1..432: note = derived and/or modified sequence opt4 from anti-HIV_cap256-119-106511_VR-Chain
  source 1..432: mol_type = other RNA
caggtgcagctggtggagagcggcggcggcgtggtgcagcccggcagaagcctgagactgagctgcgtggccagccagttcagcttcgacagatacggcatgcactgggtgagacaggcccccggcaagggcctggagtgggtggccagcatcagcttcgacggcaccgacaagtaccacgccgacaaggtgtggggcagattcaccatcagcagagacaacagcaagaacaccctgtacctgcagatgaacagcctgagacccgaggacaccgccctgtactactgcgccaaggacatgagagaggacgagtgcgaggcctggtggagcgactactacgacctgggcaagcagctgccctgcagagagagcagaggcgtggccggcatcttcgacgagtggggccagggcaccatggtgaccgtgagcagc

SEQ ID NO: 32414 - RNA, 432 nt, synthetic construct
  misc_feature 1..432: note = derived and/or modified sequence opt4 from anti-HIV_cap256-119-106327_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgccatcagcggcggcggcggcaacacctacgtggccgacagcgtgaagggcagattcaccatcagcagagacaacagcaagaacaccgtgtacctgcagatgaacagcctgagactggaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32415 - RNA, 438 nt, synthetic construct
  misc_feature 1..438: note = derived and/or modified sequence opt4 from anti-HIV_cap256-119-105486_VR-Chain
  source 1..438: mol_type = other RNA
caggtgcagctggtggagagcggcggcggcgtggtgcagcccggcggcagcctgagactgagctgcgccgccagcggcttcaccgtgagcggctacggcatgcactgggtgagacaggcccccgccaagggcctggactgggtggccttcatcagccacgacggcagcaacaagtactacgccgacagcgtgagaggcagattcatcatcagcagagacaacagcaacaacaccctgtacgtgcagatgagcagcctgagagccgaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32416 - RNA, 432 nt, synthetic construct
  misc_feature 1..432: note = derived and/or modified sequence opt4 from anti-HIV_cap256-119-105197_VR-Chain
  source 1..432: mol_type = other RNA
caggtgcagctggtggagagcggcggcggcgtggtgcagcccggcagaagcctgagactgagctgcgccgtgagccagttcaccttcggcagatacggcatgcactgggtgagacaggcccccggcaagggcctggagtgggtgggcagcatcagctacgacggcagcgacaagtaccacaccaacagcctgtggggcagattcatcgtgagcagagacaacagcaagaacaccctgtacctgcagatgaacaacctgagacccgaggacaccgccctgtactactgcgtgagagacagaagagagagcgagtgcgaggagagatggagcgactactacgacttcggcaagcagctgccctgcgtgaagcccagaggcgtggtgggcgtgctggacatctggggccagggcaccctggtgaccgtgagcagc

SEQ ID NO: 32417 - RNA, 432 nt, synthetic construct
  misc_feature 1..432: note = derived and/or modified sequence opt4 from anti-HIV_cap256-119-104946_VR-Chain
  source 1..432: mol_type = other RNA
caggagcagctggtggagagcggcggcggcgtggtgcagcccggcagaagcctgagactgagctgcgtggccagcagattcaccttcagcgccttcggcatgcactgggtgagacaggcccccggcaagggcctggagtgggtggccagcatcagcttcgccggcatcaagaagtactacggcgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcatcgacagcagaggcgtggtgggcatcctggacatctggggccagggcatcatggtgaccgtgagcagc

SEQ ID NO: 32418 - RNA, 432 nt, synthetic construct
  misc_feature 1..432: note = derived and/or modified sequence opt4 from anti-HIV_cap256-119-103667_VR-Chain
  source 1..432: mol_type = other RNA
caggtgcacctggtggagagcggcggcggcgtggtgcagcccggcaagagcctgagactgagctgcgccgccagccagttcaccttcaacagattcggcatgcactgggtgagacaggcccccggcaagggcctggagtgggtggccggcatcagctacgacggcagcgacaagtaccacgccgacaaggtgtggggcagattcaccatcagcagagacaacagcaagaacaccctgtacctgcagatgaacagcctgagagccgaggacaccgccctgtactactgcgccaaggacctgagagaggacgagtgcgaggagtgggccagcgactactacgacttcggcaaggagcagccctgcctggaccccagaggcgtggtgggcatcttcgacatctggggccagggcaccatggtgaccgtgagcagc

SEQ ID NO: 32419 - RNA, 438 nt, synthetic construct
  misc_feature 1..438: note = derived and/or modified sequence opt4 from anti-HIV_cap256-119-103385_VR-Chain
  source 1..438: mol_type = other RNA
gaggtgcagctggtggagagcggcggcggcctggtgcagaccggcggcagcctgagactgagctgcgccgccagcggcttcaccttcagcagatacgacatgaactgggtgagacaggcccccggcaagggcctggagtgggtggccagcatcagcaacgacggcagcaagaagtaccacggcgacagcgtgtgggccagattcaccatcagcagagacaacagcaagaacaccctgttcctgcagatgagcagcctgagagtggaggacaccgccctgtacttctgcgtgagagaccagagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32420 - RNA, 438 nt, synthetic construct
  misc_feature 1..438: note = derived and/or modified sequence opt4 from anti-HIV_cap256-119-103267_VR-Chain
  source 1..438: mol_type = other RNA
gaggtgcccagcgtggagagcggcggcggcctggtgcagaccggcggcagcctgaccctgagctgcgccgccagccagttcaccttcagcaactacggcatgcactgggtgagacaggcccccggcaagggcctggagtgggtggccagcatcagcaacgacggcagcaagaagtaccacggcgacagcgtgtgggccagattcatcatcagcagagacaacagcaagaacaccctgttcctgcagatgagcagcctgagagccgaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32421 - RNA, 432 nt, synthetic construct
  misc_feature 1..432: note = derived and/or modified sequence opt4 from anti-HIV_cap256-119-103011_VR-Chain
  source 1..432: mol_type = other RNA
caggtgcagctggtggagagcggcggcggcgtggtgcagcccggcggcagcctgagactgagctgcgccaccagcggcttcaccttcggcaccttcggcatgcactgggtgagacaggcccccggcaagggcctggactgggtggccgccatcagcttcgccggcaccaagaagaactacgccgacagcgtgagaggcagattcaccatcagcagagacagcagcaagaacaccctgtacctgcagatgaacagcctgagacccgaggacaccgccctgtactactgcgtgaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32422 - RNA, 438 nt, synthetic construct
  misc_feature 1..438: note = derived and/or modified sequence opt4 from anti-HIV_cap256-119-102072_VR-Chain
  source 1..438: mol_type = other RNA
gaggtgcagctggtggagagcggcggcggcctggtgcagcccggcggcagcctgagagtgagctgcgccgtgagcggcttcaccttcagcaactacgagatgaactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatctggggccacggcaccatggtgaccgtgagcagc

SEQ ID NO: 32423 - RNA, 438 nt, synthetic construct
  misc_feature 1..438: note = derived and/or modified sequence opt4 from anti-HIV_cap256-119-101945_VR-Chain
  source 1..438: mol_type = other RNA
gaggtgcagctggtggagagcggcggcggcctggtgcagcccggcggcagcctgagactgagctgcgccgccagcggcttcaccttcagcagctacgtgatgcactgggtgagacaggcccccggcaagggcctggagtgggtggccagcatcagcaacgacggcaccaagaagtaccacgaggagagcgtgtggggcagattcaccatcagcaaggacaacagcaagaacaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32424 - RNA, 432 nt, synthetic construct
  misc_feature 1..432: note = derived and/or modified sequence opt4 from anti-HIV_cap256-119-101319_VR-Chain
  source 1..432: mol_type = other RNA
caggtgcagctggtggagagcggcggcggcgtggtgcagcccggcaagagcctgagactgagctgcgtgggcagcggcttcaccttcgacgactacggcatgcactgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32425 - RNA, 432 nt, synthetic construct
  misc_feature 1..432: note = derived and/or modified sequence opt4 from anti-HIV_cap256-119-100871_VR-Chain
  source 1..432: mol_type = other RNA
caggtgcagctggtggagagcggcggcggcgtggtgcagcccggcgagagcctgagaatcagctgcgccgccagccagttcaccttcagcagatacggcatgcactgggtgagacaggcccccggcaagggcctggagtgggtggccagcatcagcttcgacggcagagacaagtaccacagcagcctggtgtggggcagactgaccatcagcagagacaacagcaagagcaccctgttcctgcagatgaacagcctgagagccgaggacaccgccctgtactactgcgccagagacctgagagagagcgagtgcgaggagtgggagagcgactactacgacttcggcaagccccagccctgcgaggaccccagaggcgtggtgggcaccttcgacatgtggggcctgggcaccctggtgaccgtgagcagc

SEQ ID NO: 32426 - RNA, 432 nt, synthetic construct
  misc_feature 1..432: note = derived and/or modified sequence opt4 from anti-HIV_cap256-119-100838_VR-Chain
  source 1..432: mol_type = other RNA
gaggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatcagatacgacggcagcaacaagtactacgccgacagcgtgaagggcagattcaccatcagcagagacaacagcaaccacaccctgtacatgcagctggacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32427 - RNA, 438 nt, synthetic construct
  misc_feature 1..438: note = derived and/or modified sequence opt4 from anti-HIV_cap256-119-100025_VR-Chain
  source 1..438: mol_type = other RNA
caggtgcagctggtggagagcggcggcggcgtggtgcagcccggcagaagcctgagactgagctgcgccgccagcgtgttcaccttcagctactacggcatgcactgggtgagacaggcccccggcaagggcctggagtgggtggccttcatcagccacgacggcagcaacaagtactacgccgacagcgtgagaggcagattcatcatcagcagagacaacagcaacaacaccctgtacgtgcagatgaacagcctgagagccgaggacaccgccctgtacttctgcgtgaaggaccagagagaggacgagtgcgaggagtggtggagcgactactacgacttcggcagagagctgccctgcagaaagttcagaggcctgggcctggccggcaccttcgacatctggggccacggcaccatgctgatcgtgagcagc

SEQ ID NO: 32428 - RNA, 432 nt, synthetic construct
  misc_feature 1..432: note = derived and/or modified sequence opt4 from anti-HIV_cap256-119-100000_VR-Chain
  source 1..432: mol_type = other RNA
cagatgcagctggtggagagcggcggcggcgtggtgcagcccggcagaagcctgaccctgagctgcgccgccagccagttcaccttcagcaactacggcatgcactgggtgagacaggcccccggcaagggcctggagtgggtggccagcatcagcaacgacggcaacaagaagtaccacggcgacagcgtgtgggccagattcaccatcagcagagacaacagcaagaacaccctgttcctgcagatgagcagcctgagaaccgaggacaccgccctgtacttctgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32429 - RNA, 432 nt, synthetic construct
  misc_feature 1..432: note = derived and/or modified sequence opt4 from anti-HIV_cap256-119-098890_VR-Chain
  source 1..432: mol_type = other RNA
caggtgcagctggtggagagcggcggcggcgtggtgcagcccggcgagagcctgagaatcagctgcgtggccagccagttcaccttcggcagatacggcatgcactgggtgagacaggcccccggcaagggcctggagtgggtggccagcatcagcttcgacggcagagacaagtaccacagccccctggtgtggggcagactgaccatcagcagagacaacagcaagaacaccctgttcctgcagatgaacagcctgagaaccgaggacaccgccctgtactactgcgccagagacctgagagagagcgagtgcgaggagtgggagagcgactactacgccttctggagaaagctgccctgcgtgaagcccagaggcgtggccggcaccctggacatctggggccagggcaccatggtgagcgtgagcagc

SEQ ID NO: 32430 - RNA, 435 nt, synthetic construct
  misc_feature 1..435: note = derived and/or modified sequence opt4 from anti-HIV_cap256-119-098715_VR-Chain
  source 1..435: mol_type = other RNA
caggtgcagctggtggagagcggcggcggcgtggtgcagcccggcagaagcctgagactgagctgcgccgccagcggcttcagcttcaacaaccacggcatgcactgggtgagacaggcccccggcaagggcctggagtgggtggccggcatcagcttcgccggcatcaagaagtactacggcaccagcgtgaagggcagattcaccatcagcagagacaacagcaagaacaacctgttcctgcagatgaacagcctgagagtggaggacaccgccctgtactactgcgccagagacctgagagagatggagtgcgaggagtggaccctgtacaactactacgacttcggcagcagaggcccctgcgtggaccccagaggcgtggtgggcagcttcgacgtgtggggccagggcaccatggtgaccgtgagcagc

SEQ ID NO: 32431 - RNA, 438 nt, synthetic construct
  misc_feature 1..438: note = derived and/or modified sequence opt4 from anti-HIV_cap256-119-098632_VR-Chain
  source 1..438: mol_type = other RNA
cagatgcagctggtggagagcggcggcggcgtggtgcagcccggcagaagcctgaccctgagctgcgccgccagccagttcaacttcgccaactacgacatgcactgggtgagacaggcccccggcaagggcctggagtgggtggccttcatcagatacgacggcaacaacaagtactacgccgacagcgtgaagggcagattcaccatcagcagagacaacagcaagagcaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32432 - RNA, 432 nt, synthetic construct
  misc_feature 1..432: note = derived and/or modified sequence opt4 from anti-HIV_cap256-119-097199_VR-Chain
  source 1..432: mol_type = other RNA
caggtgcagctggtggagagcggcggcggcgtggtgcagcccggcagaagcctgagactgagctgcgccgccagcggcttcgccttcagcagctacgccttccactgggtgagacaggcccccggcaagggcctggagtgggtggcctacatccccttccacggcaaccagcagtactacggcgacagcgtgaagggcagattcaccatcagcagagacaacagcagagacaccctgttcctggagatgaacagcctgagacccgaggacaccgccctgtacttctgcgccagagaccagagatactacgagtgcgaggagtgggccagcgactactacgacttcggcagagagcagccctgcctggaccccagaggcgtggtgggcatcttcgacctgtggggccagggcaccatggtgaccgtgagcagc

SEQ ID NO: 32433 - RNA, 432 nt, synthetic construct
  misc_feature 1..432: note = derived and/or modified sequence opt4 from anti-HIV_cap256-119-096189_VR-Chain
  source 1..432: mol_type = other RNA
caggtgcagctggtggagagcggcggcggcgtggtgcagcccggcagaagcctgagactgagctgcgccgccagcggcttcaagttcggcagcttcggcatgcactgggtgagacaggcccccggcaagggcctggagtgggtggccgtgatcagctacgacggcagcgacaagtactacggcagcagcgtgagaggcagattcagcatcagcagagacaacagcaagaacaccctgtacctgcagatgaacagcctgagaaccgaggacaccgccctgtacttctgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32434 - RNA, 432 nt, synthetic construct
  misc_feature 1..432: note = derived and/or modified sequence opt4 from anti-HIV_cap256-119-094581_VR-Chain
  source 1..432: mol_type = other RNA
caggtgcacctggtggagagcggcggcggcgtggtgcagcccggcagaagcctgagactgagctgcgccgccagcggcttcaacttcagcaactacgccatccactgggtgagacagacccccggcaagggcctggagtgggtgaccctgatcagcaacgacggcagcaacaagtactacgccgacagcctgaagggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcaagcagctgccctgcagaaagagcagaggcgtggccggcatcttcgacggctggggccagggcaccatggtgaccgtgagcagc

SEQ ID NO: 32435 - RNA, 432 nt, synthetic construct
  misc_feature 1..432: note = derived and/or modified sequence opt4 from anti-HIV_cap256-119-094200_VR-Chain
  source 1..432: mol_type = other RNA
gaggtgcagctggtggagagcggcggcggcctggtgcagcccggcggcagcctgagactgagctgcgccgccagcggcttcatcttcagcagctacgccctgcactgggtgagacaggcccccggcaagggcctggagtgggtggccagcatcagcttcgccggcaccaagaaccactacggcaacagcgtgaagggcagattcaccatcagcagagacaacagcaagaacaccgtgtacctgcagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32436 - RNA, 432 nt, synthetic construct
  misc_feature 1..432: note = derived and/or modified sequence opt4 from anti-HIV_cap256-119-094158_VR-Chain
  source 1..432: mol_type = other RNA
cagatgcagctggtggagagcggcggcggcgtggtgcagcccggcagcagcctgaccctgagctgcgccgccagccagttcaccttcagcaactacggcatgcactgggtgagacaggcccccggcaagggcctggagtgggtggccagcatcagcaacgacggcaccaagaagtaccacggcgacagcgtgtgggacagattcaccatcagcagagacaacagcaagaacaccctgttcctgcagatgaacagcctgagagccgaggacaccgccctgtacttctgcgtgaaggaccagagagaggacgagtgcgaggagtggtggagcgactactacgacttcggcaagcagctgccctgcagaaagagcagaggcgtggccggcatcttcgacagctggggccagggcaccatggtgaccgtgagcagc

SEQ ID NO: 32437 - RNA, 432 nt, synthetic construct
  misc_feature 1..432: note = derived and/or modified sequence opt4 from anti-HIV_cap256-119-092814_VR-Chain
  source 1..432: mol_type = other RNA
caggtgcagctggtggagttcggcggcggcgtggtgcagcccggcggcagcctgagactgagctgcgccgccagcggcttctacttcaccgactacggcatgcactgggtgagacaggcccccggcgagggcctgcagtgggtggccttcatcagctacgacggcaacaccaagaccaccgccgacagcgtgagaggcagattcaccctgagcagagacaacagcaagaacaccctgtacctgcagatgaacagcgtgagagtggaggacaccgccagatacttctgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32438 - RNA, 432 nt, synthetic construct
  misc_feature 1..432: note = derived and/or modified sequence opt4 from anti-HIV_cap256-119-092808_VR-Chain
  source 1..432: mol_type = other RNA
caggtgcagctggtggagagcggcggcggcgtggtgcagcccggcagaagcctgagactgagctgcgccgccagccagttcagcttcggcaactacggcatgcactgggtgagacaggcccccggcaagggcctggagtgggtggccgccatcagcttcgccggcaccaagaccaactacgccgacagcgtgaagggcagattcaccatcagcagagacaacagcaagaacaccgtgtacctgcagatgaacagcctgagagccgaggacaccgccctgtacttctgcgccaaggacatcagagagtacgagtgcgagtactggaccagcgactactacgacttcggcagaccccagccctgcatcgacagcagaggcgtggtgggcaccttcgacgtgtggggccagggcaccatggtgaccgtgagcagc

SEQ ID NO: 32439 - RNA, 432 nt, synthetic construct
  misc_feature 1..432: note = derived and/or modified sequence opt4 from anti-HIV_cap256-119-092573_VR-Chain
  source 1..432: mol_type = other RNA
caggagcagctggtggagagcggcggcggcgtggtgcagcccggcaccagcctgagactgagctgcagcgccagcggcttcaccttcagcaacttcgccatgaactgggtgagacaggcccccggcaagggcctggagtgggtgagcttcatcagcagcgacggcaagaacaagaactacgtggacagcgtgaagggcagattcaccatcagcagagacaactacaagaacaccctgtacctgcagatgaacagcctgagaaccgaggacaccgccgtgtactactgcgccaaggacctgggcggcaccaaggacgacgagtgggccaccgactactacgactggagcaccgcctaccccgtgcaggaccccagagccgtggccggcggcttcgacctgtggggcctgggcaccatggtgaccgtgagcagc

SEQ ID NO: 32440 - RNA, 432 nt, synthetic construct
  misc_feature 1..432: note = derived and/or modified sequence opt4 from anti-HIV_cap256-119-090815_VR-Chain
  source 1..432: mol_type = other RNA
caggtgcagctggtggagagcggcggcggcgtggtggagcccggcagaagcctgagactgagctgcgccgccagccagttcagcttcagcagctacggcatgcactgggtgagacaggcccccggcaagggcctggagtgggtggccgccatcagcttcgacggcgccgacaagtaccacgccgacaacgtgtggggcagactgagcatcagcagagacaacagcaagagcaccctgtacctgcagatgaacagcctgagacccgaggacaccgccgtgtacttctgcgccaaggacctgagagaggacgagtgcgaggagagatggagcgactactacgacttcggcaagcagctgccctgcagaaagagcagaggcgtggccggcatcttcgacaactggggccagggcaccatggtgaccgtgagcgcc

SEQ ID NO: 32441 - RNA, 438 nt, synthetic construct
  misc_feature 1..438: note = derived and/or modified sequence opt4 from anti-HIV_cap256-119-090368_VR-Chain
  source 1..438: mol_type = other RNA
caggtgcagctggtggagagcggcggcggcgtggtgcagcccggcagaagcctgagactgagctgcgccgccagcggcttcgccttcagccactacggcatcttctgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32442 - RNA, 432 nt, synthetic construct
  misc_feature 1..432: note = derived and/or modified sequence opt4 from anti-HIV_cap256-119-089710_VR-Chain
  source 1..432: mol_type = other RNA
caggtgcagctggtggagagcggcggcggcgtggtgcagcccggcagaagcctgagactgagctgcaccgccagcggcttcggcttcagcaactacgccatgcactgggtgagactggcccccggcaagggcctggagtgggtggccagcatcagctacgacggcagagactaccaccacgccggcgccgtgtggggcagattcatcatcagcagagacaacagcaagaacagcctgcacctgcagatgaacagcctgagacccgaggacaccgccctgtacttctgcgccagagacctgagagagagcgagtgcgaggagtgggagagcgactactacaacttctggaagaagctgccctgcgtgaagcccagaggcgtggtgggcatcctggacatctggggccagggcaccgtggtgaccgtgagcagc

SEQ ID NO: 32443 - RNA, 432 nt, synthetic construct
  misc_feature 1..432: note = derived and/or modified sequence opt4 from anti-HIV_cap256-119-088555_VR-Chain
  source 1..432: mol_type = other RNA
caggtgcagctggtggagagcggcggcggcgtggtgcaggccggcagaagcctgagactgagctgcgccgccagccagttcaccttcagcagatacggcatgcactgggtgagacaggcccccggcaagggcctggagtgggtggccggcatcagctacgacggcagagacaagtaccacgcccacttcgtgtggggcagattcatcatcagcagagacaacagcaagaacaccctgtacctgcagatgaacagcctgagagccgaggacaccgccctgtactactgcgtgagagacctgagagagagcgagtgcgagctgtgggagagcgactactacgacttcggcaagagactgccctgcgtgaagcccagaggcgtggccggcaccttcgacctgtggggccagggcaccatggtgaccgtgagcagc

SEQ ID NO: 32444 - RNA, 432 nt, synthetic construct
  misc_feature 1..432: note = derived and/or modified sequence opt4 from anti-HIV_cap256-119-087962_VR-Chain
  source 1..432: mol_type = other RNA
gagatgcagctggtggagagcggcggcggcctggtgaagcccggcagaagcctgagactgagctgcgccgccagcggcttcaccttcagcagctacgccatccactgggtgagacaggcccccggcaagggcctggagtgggtggccgtgatcagctacgacggcagcaacaagtactacgccgacagcgtgaagggcagattcaccatcagcagagacaacagcaagaacaccgtgtacctgcagatgaacagcctgagagtggaggacaccgccctgtactactgcgccaaggacctgagagagtacgagtgcgaggagtggaccagcgactactacgacttcggcaagccccagccctgcatcgacagcagaggcgtggtgggcatcctggacatctggggccagggcatcatggtgaccgtgagcagc

SEQ ID NO: 32445 - RNA, 432 nt, synthetic construct
  misc_feature 1..432: note = derived and/or modified sequence opt4 from anti-HIV_cap256-119-086903_VR-Chain
  source 1..432: mol_type = other RNA
caggtgcacctggtggagagcggcggcggcgtggtgcagcccggcaagagcctgagactgagctgcgccgccagccagttcaccttcgacagatacggcatgcactgggtgagacaggcccccggcaagggcctggagtgggtggccagcatcagcaacgacggcaccgacaagtaccacgccgacaacgtgtggggcagattcaccatcagcagagacaacagcaagaacaccctgtacctggagatgaacagcctgagaggcgaggacaccgccctgtactactgcgccaaggacatgagagaggacgagtgcgaggagtggtggagcgactactacgacttcggcagaccccagccctgcatcgacagcagaggcgtggtgggcaccttccacgtgtggggccagggcaccatggtgaccgtgagcagc

SEQ ID NO: 32446 - RNA, 432 nt, synthetic construct
  misc_feature 1..432: note = derived and/or modified sequence opt4 from anti-HIV_cap256-119-086804_VR-Chain
  source 1..432: mol_type = other RNA
gaggtgcagctggtggagagcggcggcggcgtggtgcagcccggcagaagcctgagactgttctgcgccggcagcggcttcaccttcagcagctacggcctgcactgggtgagacaggcccccggcaagggcctggagtgggtgagcttcatcagctacgacggcagcaccaccaagtacgccgacagcctgaagggcagattcaccgtgagcagagacaacagcaagaacaccgtgtacctggagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32447 - RNA, 432 nt, synthetic construct
  misc_feature 1..432: note = derived and/or modified sequence opt4 from anti-HIV_cap256-119-085910_VR-Chain
  source 1..432: mol_type = other RNA
gaggtgcagctgctggagagcggcggcggcctggtgcagcccggcggcagcctgagactgagctgcgccgccagcggcttcaccttcagcagctacggcatgcactgggtgagacaggccgccggcaagggcctggagtgggtggccagcatcagctacgacggcagagactaccaccacgccggcgccgtgtggggcagattcatcatcagcagagacaacagcaagaacagcctgcacctgcagatgaacagcctgagacccgaggacaccgccctgtacttctgcgccagagacctgagagagagcgagtgcgaggagtgggagagcgactactacaacttctggaagaagctgccctgcgtgaagcccagaggcgtggtgggcatcctggacatctggggccagggcaccgtggtgaccgtgagcagc

SEQ ID NO: 32448 - RNA, 432 nt, synthetic construct
  misc_feature 1..432: note = derived and/or modified sequence opt4 from anti-HIV_cap256-119-085772_VR-Chain
  source 1..432: mol_type = other RNA
gaggtgagactggtggagagcggcggcggcctgatccagcccggcggcagcctgagactgagctgcgccgccagcggcctgaccgtgagcagcaaccacatgagctgggtgagacaggcccccggcaagggcctggagtgggtggccgtgatcagctacgacggcagcaacaccttctacggcgacagcgtgaagggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32449 - RNA, 432 nt, synthetic construct
  misc_feature 1..432: note = derived and/or modified sequence opt4 from anti-HIV_cap256-119-084603_VR-Chain
  source 1..432: mol_type = other RNA
caggtgcagctggtggagagcggcggcggcgtggtgcagagcggcagaagcctgagactgagctgcgccgccagcggcttccccttcagcgacttcgccatgcactgggtgagacaggcccccggcaagggcctggagtgggtggccagcatcagcttcgtgggcatcaagacccactacgccaacagcgtgagaggcagattcaccatcagcagagaccagagcaagaacaccctgtacctgcagatgaacagcgtgagagtggaggacaccggcagatactactgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32450 - RNA, 432 nt, synthetic construct
  misc_feature 1..432: note = derived and/or modified sequence opt4 from anti-HIV_cap256-119-084276_VR-Chain
  source 1..432: mol_type = other RNA
caggtgcagctggtggagagcggcggcggcgtggtgcagcccggcagaagcctgagactgagctgcgccgccagcagattcaccttcagcagctacgccatgcactgggtgagacaggcccccggcaagggcctggagtgggtggccgtgatctggtacgacggcagcaacaagtactacgccgacagcgtgagaggcagattcagcgtgagcaccgacatcagcaagaacaccctgtacctgcagatgaacagcctgagacccgccgacaccgccctgtacttctgcgccagagacctgagatactacgagtgcgaggagtgggccagcgactactacgacttcggcaaggagcagccctgcctggaccccagaggcgtggtgggcatcttcgacctgtggggccagggcaccatggtgaccgtgagcagc

SEQ ID NO: 32451 - RNA, 432 nt, synthetic construct
  misc_feature 1..432: note = derived and/or modified sequence opt4 from anti-HIV_cap256-119-082288_VR-Chain
  source 1..432: mol_type = other RNA
caggtgtacctggtggagagcggcggcggcgtggtgcagcccggcagaagcctgagactgagcagcgccgccagccacttcagcctgagcagctacggcatgcactgggtgagacaggcccccggcaagggcctggagtgggtggccggcatcagcttcgccggcaccaagacctactacggcgacagcgtgaagggcagattcaccgtgagcaccgacatcagcaagaacaccctgtacctgcaggtgaacagcctgagacccgaggacaccgccatgtactactgcgccagagaccagagatactacgagtgcgaggagtgggccagcgactactacgacttcggcaaggagcagccctgcctggaccccagaggcgtggtgggcatcttcgacatctggggccagggcaccatggtgaccgtgagcagc

SEQ ID NO: 32452 - RNA, 432 nt, synthetic construct
  misc_feature 1..432: note = derived and/or modified sequence opt4 from anti-HIV_cap256-119-080383_VR-Chain
  source 1..432: mol_type = other RNA
caggtgcagctggtggagagcggcggcggcgtggtgcagcccggcagaagcctgagaatcagctgcgccgccagccagttcaccttcagcagatacggcatgcactgggtgagacaggcccccggcaagggcctggagtgggtggccagcatcagctacgacggcaccgacaagtaccacgccagactggtgtggggcagattcaccatcagcagagacaacagcaagaacaccctgtacctgcagatgaacagcctgagagccgaggacaccgccctgtactactgcgtgagagacgagagagagagcgagtgcgagctgtgggagagcgactactacgacttcggcaagaagctgccctgcgtgaagcccagaggcgtgaccggcagcctggacatgtggggccagggcacccaggtgaccgtgagcagc

SEQ ID NO: 32453 - RNA, 438 nt, synthetic construct
  misc_feature 1..438: note = derived and/or modified sequence opt4 from anti-HIV_cap256-119-079333_VR-Chain
  source 1..438: mol_type = other RNA
gaggtgcagctggtggagagcggcggcagactggtgcagcccggcagccccctgagactgagctgcgccgccagccagttcaacttcgccagctacggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32454 - RNA, 441 nt, synthetic construct
  misc_feature 1..441: note = derived and/or modified sequence opt4 from anti-HIV_cap256-119-078618_VR-Chain
  source 1..441: mol_type = other RNA
cagatgcagctggtggagagcggcggcggcgtggtgcagcccggcagaagcctgaccctgagctgcgccgccagccagttcaacttcgccagctacggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccaccctgtacttctgcgtgaaggaccagagagaggacgagtgcgaggagtggtggagcgactactacgacttcggcagagagctgccctgcagaaagagcagaggcctgggcctggccggcaacttctgcatctgcggcgccgacggcaccatggtgaccgtgagcagc

SEQ ID NO: 32455 - RNA, 432 nt, synthetic construct
  misc_feature 1..432: note = derived and/or modified sequence opt4 from anti-HIV_cap256-119-077466_VR-Chain
  source 1..432: mol_type = other RNA
caggtgcagctggtggagagcggcggcggcgtggtgcagcccggcagccccctgagaatcagctgcgccgtgagccagttcaccttcagcagatacggcatgcactgggtgagacaggcccccggcaagggcctggagtgggtggccagcatcagcttcgacggcagagacaagtaccacagcagcctggtgtggggcagactgaccatcagcagagacaacagcaagagcaccctgttcctgcagatgaacagcctgagagccgaggacaccgccctgtactactgcgccagagacctgagagagagcgagtgcgaggagtgggagagcgactactacgccttctacagaaagctgccctgcgtgaagcccagaggcgtggccggcaccctggacatctggggccagggcaccatggtgaccgtgagcagc

SEQ ID NO: 32456 - RNA, 423 nt, synthetic construct
  misc_feature 1..423: note = derived and/or modified sequence opt4 from anti-HIV_cap256-119-076284_VR-Chain
  source 1..423: mol_type = other RNA
caggtgcagctggtggagagcggcggcggcgtggtgcagcccggcagaagcctgagactgagctgcgccgccagcaacacctacgccatgcactgggtgagacaggcccccggcaagggcctggagtggatggccctgatcagctacgagggcagcgacaagtactacgtggacagcgtgaagggcagattcaccatcagcagagacaacagcaagagcaccctgtacctgcagatgaacagcctgagcgccgaggacaccgccgtgtacttctgcgccaaggacctgggcggcaacaaggacgacgagtggaccaccgactactactacgactggagcaaggccagacccgtgcaggaccccagagtggtggccggcaccttcgacatctggggccagggcaccatggtgaccgtgagcagc

SEQ ID NO: 32457 - RNA, 432 nt, synthetic construct
  misc_feature 1..432: note = derived and/or modified sequence opt4 from anti-HIV_cap256-119-074680_VR-Chain
  source 1..432: mol_type = other RNA
gaggtgcagctggtggagagcggcggcggcctggtgcagcccggcagaagcctgagactgagctgcgccggcagcggcttcaccttcgtggactacgccatgcactgggtgagacaggtgcccggcaagggcctggagtgggtgggcagcatcagctacgacggcagcgacaagtaccacaccaacagcgtgtggggcagattcatcgtgagcagagacaacagcaagaacaccctgtacctgcagatgaacagcctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32458 - RNA, 432 nt, synthetic construct
  misc_feature 1..432: note = derived and/or modified sequence opt4 from anti-HIV_cap256-119-074081_VR-Chain
  source 1..432: mol_type = other RNA
gaggtgcagctggtggagagcggcggcggcctggtgcagcccggcggcagcctgagactgagctgcgtggtgagcggcgtgaccgtgagcagcaactacatgagctgggtgagacaggcccccggcaagggcctggagtgggtggccagcatcagctacgacggcagcgacaagtaccacgccgacagagtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32459 - RNA, 432 nt, synthetic construct
  misc_feature 1..432: note = derived and/or modified sequence opt4 from anti-HIV_cap256-119-071704_VR-Chain
  source 1..432: mol_type = other RNA
cagatgcagctggtggagagcggcggcggcgtggtgcagcccggcggcagcctgagactgagctgcgccgtgagccagttcaccttcaccagctacggcatgcactgggtgagacaggcccccggcaagggcctggagtgggtggccaccatcagcagcgacggcagcaagaagtaccacggcgacagcgtgtggggcagactgaccatcagcagagacaacagcaagaacaccctgttcctgcagatgaacaacctgagagccgaggacaccgccctgtacttctgcgtgaaggaccagagagaggacgagtgcgaggagtggtggagcgactactacgacttcggcaagaagctgccctgcagaaagagccccggcctggccggcatcttcgacgtgtggggccacggcaccatggtgaccgtgagcccc

SEQ ID NO: 32460 - RNA, 432 nt, synthetic construct
  misc_feature 1..432: note = derived and/or modified sequence opt4 from anti-HIV_cap256-119-071266_VR-Chain
  source 1..432: mol_type = other RNA
caggtgcagctggtggagagcggcggcggcgtggtgcagcccggcgagagcctgagactgagctgcgccgccagcggcttcaccttcagcagcttcggcatgcactgggtgagacaggcccccggcaagggcctggagtgggtgggcagcatcagctacgacggcagcgacaagtaccacaccaacagcgtgtggggcagattcatcgtgagcagagacaacagcaagaacaccctgtacctgcagatgaacagcctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32461 - RNA, 432 nt, synthetic construct
  misc_feature 1..432: note = derived and/or modified sequence opt4 from anti-HIV_cap256-119-069667_VR-Chain
  source 1..432: mol_type = other RNA
gaggtgcagctggtggagagcggcggcggcctggtgcagcccggcagaagcctgagactgagctgcgccgccagcggcttcagcttcaacacctacggcatgcactgggtgagacaggcccccggcaagggcctggagtgggtggccttcatcagatacgacggcagcaacaagtactacgccgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32462 - RNA, 432 nt, synthetic construct
  misc_feature 1..432: note = derived and/or modified sequence opt4 from anti-HIV_cap256-119-069591_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccggcatcagctacgacggcagcgacaagtaccacgccgacaaggtgtggggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcaagagactgccctgcagaaagagcagaggcgtggccggcgtgttcgacaagtggggccagggcaccatggtgaccgtgagcagc

SEQ ID NO: 32463 - RNA, 432 nt, synthetic construct
  misc_feature 1..432: note = derived and/or modified sequence opt4 from anti-HIV_cap256-119-068691_VR-Chain
  source 1..432: mol_type = other RNA
cagggccacctggtggccagcggcggcggcgtggtgccccccggcagaagcctgaccctgagctgcctggccagccagttcaccttcagcggctacggcttccactgggtgagacaggcccccggcaagggcctggagtgggtggccagcatcagcttcgccggcaccaagaagcactacggcaacagcgtgaagggcagattcaccatcagcagagacaacagcaagaacaccctgtacctggagatgaacagcctgagacccgaggacaccgccctgtactactgcgccaaggacagaagagagtacgagtgcgaggagtggaccagcgactactacgacttcggcagaccccagccctgcatcgacagcagaggcgtggtgggcatcctggacatctggggcagaggcaccatggtgaccgtgagcagc

SEQ ID NO: 32464 - RNA, 432 nt, synthetic construct
  misc_feature 1..432: note = derived and/or modified sequence opt4 from anti-HIV_cap256-119-068488_VR-Chain
  source 1..432: mol_type = other RNA
cagatgcagctggtggagagcggcggcggcgtggtgcagcccggcatgagcctgaccctgagctgcgccgccagccagttcaccttcagcaactacggcatgcactgggtgagacaggcccccggcaagggcctggagtgggtggccagcatcagcaacgacggcagcaagaagtaccacggcgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32465 - RNA, 432 nt, synthetic construct
  misc_feature 1..432: note = derived and/or modified sequence opt4 from anti-HIV_cap256-119-067536_VR-Chain
  source 1..432: mol_type = other RNA
caggtgcagctggtggagagcggcggcggcgtggtgcagcccggcagaagcctgagaatcagctgcgccagcagccagttcaccttcagcagatacggcatgcactgggtgagacaggcccccggcaagggcctggagtgggtggccagcatcagctacgacggcagagactaccaccacgccggcgccgtgtggggcagattcatcatcagcagagacaacagcaagaacagcctgcacctgcagatgaacagcctgagacccgaggacaccgccctgtacttctgcgccagagacctgagagagagcgagtgcgaggagtgggagagcgactactacgccttctacagaaagctgccctgcgtgaagcccagaggcgtggccggcaccctggacatctggggccagggcaccatggtgaccgtgagcagc

SEQ ID NO: 32466 - RNA, 432 nt, synthetic construct
  misc_feature 1..432: note = derived and/or modified sequence opt4 from anti-HIV_cap256-119-065852_VR-Chain
  source 1..432: mol_type = other RNA
caggtgcacctggtggagagcggcggcggcgccgtgcccagcggcagaagcctgagactgagctgcgtggccagcggcttcaccttcggcgtgtacgacatccactgggtgagacaggcccccggcaagggcctggagtgggtggccagcatcagctacgacggcagagacaagtaccacagcagcctggtgtggggcagactgaccatcagcagagacaacagcaagagcaccctgttcctgcagatgaacagcctgagagccgaggacaccgccctgtactactgcgccagagacctgagagagagcgagtgcgaggagtggcagagcgactactacgccttctacaagaagctgccctgcgtgaagcccagaggcgtggccggcaccctggacatctggggccagggcaccatggtgaccgtgagcagc

SEQ ID NO: 32467 - RNA, 432 nt, synthetic construct
  misc_feature 1..432: note = derived and/or modified sequence opt4 from anti-HIV_cap256-119-065457_VR-Chain
  source 1..432: mol_type = other RNA
ctgggcagactggtggccagcggcggcggcgtggtgccccccggcagaagccccagactgagctgcgtggccagccagttcaccttcagcggctgcggcctgcactgggtgagacaggcccccggcaagggcctggagtgggtggccgccatcagcttcgacggcaccgacaagtaccacagcgacgacgtgtggggcagattcaccatcagcagagacaacagcaagaacaccctgtacctgcagatgaacagcctgagacccgaggacaccgccctgtactactgcgccaaggacctgcaggaggacgagtgcgaggagtggtggagcgactactacgacttcggcaagcagctgccctgcagaaagagcagaggcgtggccggcatcttcgacgactggggccagggcaccatggtgaccgtgagcagc

SEQ ID NO: 32468 - RNA, 432 nt, synthetic construct
  misc_feature 1..432: note = derived and/or modified sequence opt4 from anti-HIV_cap256-119-064501_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccggcatcagctacgacggcagagacaagtaccacgcccacagcgtgtggggcagactgagcatcagcagagacaacagcaagaacaccctgtacctgcagatgaacagcctgagaaccgaggacaccgccctgtaccactgcgtgagagacctgagagagagcgagtgcgagctgtgggagagcgactactacgacttcggcaagaagctgccctgcgtgaagcccagaggcgtggccggcaccttcgacctgtggggccagggcaccatggtgaccgtgagcagc

SEQ ID NO: 32469 - RNA, 432 nt, synthetic construct
  misc_feature 1..432: note = derived and/or modified sequence opt4 from anti-HIV_cap256-119-063568_VR-Chain
  source 1..432: mol_type = other RNA
caggtgcagcccgtggagagcggcggcggcgtggtgtggcccggcagaagcctgagactgagctgcaccaccagcggcttcaccttcagcaactacgccatccactgggtgagacaggcccccggcaagggcctgcagtgggtggccgtgatcagctacgacggcagcaacaagttctacgccgacagcgtgaagggcagattcaccatcagcagagacaacagcaagaacaccctgtacctgcagatgaacagcctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32470 - RNA, 435 nt, synthetic construct
  misc_feature 1..435: note = derived and/or modified sequence opt4 from anti-HIV_cap256-119-063103_VR-Chain
  source 1..435: mol_type = other RNA
caggtgcagctggtggagagcggcggcggcctggtgcagcccggcaagagcctgagactgagctgcgccgccagcggcttcaccttcagcacctacggcatgcactgggtgagacaggcccccggcaagggcctggagtgggtggccctgatcagctacgacggcagctacacctactacgccgacagcgtgaagggcagattcaccatcagcagagacaacagcaagagcaccctggacctgcagctgaacaccctgagacccgaggacaccgccctgtactactgcgccagagacctgagagagatggagtgcgaggagtggaagctgtacaactactacgacttcagaaccagaggcccctgcgtggaccccagaggcgtggtgggcagcttcgacgtgtggggccagggcaccgtggtgaccgtgagcagc

SEQ ID NO: 32471 - RNA, 432 nt, synthetic construct
  misc_feature 1..432: note = derived and/or modified sequence opt4 from anti-HIV_cap256-119-061027_VR-Chain
  source 1..432: mol_type = other RNA
caggtgcagctggtggagagcggcggcggcgtggtgcagcccggcagaagcctgagactgagctgcagcgccagcggcttcaccctgagcagctacggcatccactgggtgagacaggcccccggcaagggcctggagtgggtggccgtgatgagcaacgacggcagcaaccagttctacggcgacagcgtgaagggcagattcaccatcagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32472 - RNA, 432 nt, synthetic construct
  misc_feature 1..432: note = derived and/or modified sequence opt4 from anti-HIV_cap256-119-058232_VR-Chain
  source 1..432: mol_type = other RNA
caggtgcagctggtggagagcggcggcggcgtggtgcagcccggcaagagcctgagactgagctgcaaggccagccagttcaccttcaacagatacggcatgcactgggtgagacaggcccccggcaagggcctggagtgggtggccgccatcagcttcgacggcaccgacaagtaccacgccgacaaggtgtggggcagattcaccatcagcagagacgacagcaagagcaccctgtacctgcagatgaacagcctgagagccgaggacaccgccctgtactactgcgccaaggacctgagagaggacgagtgcgaggagtggtggagcgactactacgacttcggcaagcagctgccctgcagaaagagcagaggcgtggccggcatcttcgacggctggggccagggcaccatggtgaccgtgagcagc

SEQ ID NO: 32473 - RNA, 432 nt, synthetic construct
  misc_feature 1..432: note = derived and/or modified sequence opt4 from anti-HIV_cap256-119-057341_VR-Chain
  source 1..432: mol_type = other RNA
caggtgcagctggtggagagcggcggcggcgtggtgcagcccggcagaagcctgagactgagctgcgccgccagccacttcagcctgagcagctacggcatgcactgggtgagacaggcccccggcaagggcctggagtgggtggccggcgagagcttcgccgccaccaacaagtactacgccgacagcgtgaagggcagattcatcgtgagcagagacatcagcaagaacaccctgtacctggaggtgaacagcctgagagccgaggacaccgccctgtactactgcgccagagaccagagatactacgagtgcgaggagtgggccagcgactactacgacttcggcagagagcagccctgccaggaccccagaggcgtggccggcatcttcgacatctggggccagggcaccatggtgaccgtgagcagc

SEQ ID NO: 32474 - RNA, 438 nt, synthetic construct
  misc_feature 1..438: note = derived and/or modified sequence opt4 from anti-HIV_cap256-119-056895_VR-Chain
  source 1..438: mol_type = other RNA
cagatgcagctggtggagagcggcggcggcgtggtgcagcccggcagaagcctgagactgagctgcgccgccagccagttcaccttcggcagctacggcatgcactgggtgagacagatccccggcaagggcctggagtgggtggccaccatcagctacgacggcaccaagaagtaccacgccgacagcgtgtgggacagattcatcatcagcagagacaacagcaagaacaccctgttcctgcagatgaacagcctgagacccgaggacaccgccctgtacttctgcgtgaaggaccagagacaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32475 - RNA, 432 nt, synthetic construct
  misc_feature 1..432: note = derived and/or modified sequence opt4 from anti-HIV_cap256-119-056402_VR-Chain
  source 1..432: mol_type = other RNA
caggtgaagctggtggagagcggcggcggcgtggtgcagcccggcaagagcctgagactgagctgcaccgccagccagttcaccttcagcaacttcggcatgcactgggtgagacaggcccccggcaagggcctggagtgggtggccagcatcagcttcgtgggcatcaagaagcactacgccaacagcgtgagaggcagattcaccatcagcagagaccagagcaagaacaccctgtacctgcagatgaacagcgtgagagtggaggacaccgccagatacttctgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32476 - RNA, 432 nt, synthetic construct
  misc_feature 1..432: note = derived and/or modified sequence opt4 from anti-HIV_cap256-119-056034_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgccatcagcttcgccggcaccaagacccactacgccgacagcgtgaagggcagattcaccatcagcagagacaacagcaagaacgccctgtacctgcagatgaacaacctgagagccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32477 - RNA, 432 nt, synthetic construct
  misc_feature 1..432: note = derived and/or modified sequence opt4 from anti-HIV_cap256-119-055042_VR-Chain
  source 1..432: mol_type = other RNA
caggtgcagctggtggagagcggcggcggcgtggcccagcccggcagaagcctgagactgagctgcgccgccagcggcttcaccttcagaagctacggcatgcactgggtgagacaggcccccggcaagggcctggagtgggtggccgtgatcagcctggacggcagcaacaagtactacgccgacagcgtgaagggcagattcagcatcagcagagacaacagcaagaacaccctgtacctgcagatgaacagcctgagacccgaggacaccgccgtgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32478 - RNA, 438 nt, synthetic construct
  misc_feature 1..438: note = derived and/or modified sequence opt4 from anti-HIV_cap256-119-054776_VR-Chain
  source 1..438: mol_type = other RNA
caggtgcagctgatggagagcggcggcggcgtggtgcagcccggcagaagcctgagactgagctgcaccgccagcggcttcaccttcagcagctacagcatgcactgggtgagacaggcccccggcaagggcctggagtgggtggccatcatcagctacgacgagagcaacaagtactacgccgacagcgtgcagggcagattcaccatcagcagagacaacagcaagaacaccctgttcctgcagatgagcagcctgagagccgaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32479 - RNA, 432 nt, synthetic construct
  misc_feature 1..432: note = derived and/or modified sequence opt4 from anti-HIV_cap256-119-054539_VR-Chain
  source 1..432: mol_type = other RNA
cagatgcagctggtggagagcggcggcggcgtggtgcagcccggcggcagcctgagactgagctgcgccgccagccagttcaccttcggcagctacgccatgcactgggtgagacagccccccggcgagagacccgagtgggtggccaccatcagcttcgacggcaccaagaagtaccacgccgacagcgtgtggggcagattcaccatcagcagagacaacagcaagaacaccctgttcctgcagatgaacagcctgagacccgaggacaccgccctgtacttctgcgtgaaggaccagagagaggacgcctgcgaggagtggtggagcgactactacgacttcggcaagaactgcctggccgagagccccggcgcctggctggagttcttctacgtgtggggccacggcaccatggtgaccgtgagcagc

SEQ ID NO: 32480 - RNA, 432 nt, synthetic construct
  misc_feature 1..432: note = derived and/or modified sequence opt4 from anti-HIV_cap256-119-054112_VR-Chain
  source 1..432: mol_type = other RNA
caggtgcagctggtggagagcggcggcggcgtggtgcaggccggcagaagcctgagactgagctgcgccgccagcggcttcaccttcagcacctacgccatgcactgggtgagacaggcccccggcaagggcctggagtgggtggccgtgatcagctacgacggcagcaacaagtactacgccgacagcgtgagaggcagattcaccatcagcagagacaacagcaagaacaccctgtacctgcagatgaacagcctgagagccgaggacaccgccctgtactactgcgccaaggacatgagagagtacgagtgcgaggagtggaccagcgactactacgacttcggcagaccccagccctgcatcgacagcagaggcgtggtgggcaccttccacgtgtggggccagggcaccatggtgaccgtgagcagc

SEQ ID NO: 32481 - RNA, 432 nt, synthetic construct
  misc_feature 1..432: note = derived and/or modified sequence opt4 from anti-HIV_cap256-119-053339_VR-Chain
  source 1..432: mol_type = other RNA
caggtgcacctggtggagagcggcggcggcgtggtgcagcccggcagaagcctgagactgagctgcgccgccagccacttcagcctgagcagctacggcatgcactgggtgagacaggcccccggcaagggcctggagtgggtgaccggcatcagcttcgccggcaccaagacctactacggcgacagcgtgagaggcagattcaccgtgagcagagacatcagcaagaacaccctgctgctgcagatgaacagcctgagacccgacgacaccgccatctactactgcgccagagaccagagatactacgagtgcgaggagtgggccagcgactactacgacttcggcaaggagcagccctgcctggaccccagaggcgtggtgggcatcttcgacctgtggggccagggcaccatggtgaccgtgagcagc

SEQ ID NO: 32482 - RNA, 432 nt, synthetic construct
  misc_feature 1..432: note = derived and/or modified sequence opt4 from anti-HIV_cap256-119-052404_VR-Chain
  source 1..432: mol_type = other RNA
cagatgcagctggtggagagcggcggcggcgtggtgcagcccggcagaagcctgaccctgagctgcatcgccagccagttcaacttcgccagctacggcatgcactgggtgagacaggcccccggcaagggcctggagtgggtggccagcatcagccacgacggcaccaagaagtaccacgccgagagcgtgtggggcagattcaccatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcaagcagctgccctgcagaaagagcagaggcgtggccggcgtgttcgacaactggggccagggcaccatggtgaccgtgagcagc

SEQ ID NO: 32483 - RNA, 432 nt, synthetic construct
  misc_feature 1..432: note = derived and/or modified sequence opt4 from anti-HIV_cap256-119-051123_VR-Chain
  source 1..432: mol_type = other RNA
caggtgcagctggtggagagcggcggcggcgtggtgcagcccggcggcagcctgagactgagctgcgtgggcagccagttcatcctgtacagatacggcatgcactgggtgagacaggcccccggcaagggcctggagtgggtggccgccgtgagcttcgacggcaccgacaagtaccacgccgacgacgtgtggggcagattcaccatcagcagagacaacagcaagaacatcctgtacctgcagatgaacagcctgagagccgaggacaccgccctgtactactgcgccaaggacctgagagaggacgagtgcgaggagtggtggagcgactactacgacctgggcaagcagctgccctgcagaaagagcagaggcgtggccggcgtgttcgacaagtggggcctgggcaccatggtgaccgtgagcagc

SEQ ID NO: 32484 - RNA, 438 nt, synthetic construct
  misc_feature 1..438: note = derived and/or modified sequence opt4 from anti-HIV_cap256-119-051077_VR-Chain
  source 1..438: mol_type = other RNA
gaggtgcagctggtggagagcggcggcggcgtggtgcagagcggcagaagcctgagactgagctgcgccgccagccacttcaccttcagcagatacggcatgcactgggtgagacaggcccccggcaagggcctggagtgggtggccagcatcagctacgacggcagagacttctaccacgccagaagcgtgtggggcagattcaccatcagcagagacaacagcaagaacaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32485 - RNA, 432 nt, synthetic construct
  misc_feature 1..432: note = derived and/or modified sequence opt4 from anti-HIV_cap256-119-050442_VR-Chain
  source 1..432: mol_type = other RNA
caggcccagatggtggagagcggcggcggcgtggtgcagcccggcagaagcctgagactgagctgcgccgccagcggcttcagcttcagctacttcgccatgcactgggtgagacaggcccccggcaagggcctggagtgggtggccggcatcagcttcgccgccaccaagacctactacggcggcagcgtgaagggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32486 - RNA, 432 nt, synthetic construct
  misc_feature 1..432: note = derived and/or modified sequence opt4 from anti-HIV_cap256-119-049433_VR-Chain
  source 1..432: mol_type = other RNA
caggtgcagctggtggagagcggcggcggcgtggtgcagcccggcagaagcctgagagtgagctgcagagccagcggcttcgccttcagcagctacgccatgcactgggtgagacaggcccccgtgaagggcctggagtgggtggccctgaccagcagcgacggcgccgacaagtaccacgccgacgacgtgtggggcagattcaccatcagcagagacaacagcaagaacaccctgtacctgcagatgaacagcctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32487 - RNA, 432 nt, synthetic construct
  misc_feature 1..432: note = derived and/or modified sequence opt4 from anti-HIV_cap256-119-047532_VR-Chain
  source 1..432: mol_type = other RNA
ctgggcagactggtggccagcggcggcggcgtggtgccccccggcagaagcctgaccctgagctgcgtggccagccagttcaccttcagcggctgcggcctgcactgggtgagacaggcccccggcaagggcctggagtgggtggccagcatcagcttcgccggcaccaagaagcactacaccaacagcgtgagaggcagattcaccatcagcagagacaacagcaagaacaccgtgtacctgcagatgaacagcctgagagccgaggacaccgccctgtactactgcgccaaggacatgggcgagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32488 - RNA, 432 nt, synthetic construct
  misc_feature 1..432: note = derived and/or modified sequence opt4 from anti-HIV_cap256-119-047489_VR-Chain
  source 1..432: mol_type = other RNA
caggtgcacctggtggagagcggcggcggcgtggtgcagcccggcaagagcctgagactgagctgcgccgccagccagttcaccttcaacagattcggcatgcactgggtgagacaggcccccggcaagggcctggagtgggtggccggcatcagctacgacggcagcgacaagtaccacgccgacaaggtgtggggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcaagagactgccctgcagaaagagcagaggcgtggccggcgtgttcgacaagtggggccagggcaccatggtgaccgtgagcagc

SEQ ID NO: 32489 - RNA, 438 nt, synthetic construct
  misc_feature 1..438: note = derived and/or modified sequence opt4 from anti-HIV_cap256-119-046020_VR-Chain
  source 1..438: mol_type = other RNA
gaggtgcagctgctgcagagcggcggcggcctggtgcagcccggcggcagcctgagactgagctgcgccgccagcggcttcagcttcagcagctacgccatgagctggatcagacaggcccccggcaagggcctggagtgggtggccagcatcagccacgacggcaccaagaagtaccacgccgagagcgtgtggggcagattcaccatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32490 - RNA, 432 nt, synthetic construct
  misc_feature 1..432: note = derived and/or modified sequence opt4 from anti-HIV_cap256-119-044746_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacaagtactacgccgacagcgtgaagggcagattcaccatcagcagagacaacagcaagaacaccgtgtacctggagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32491 - RNA, 432 nt, synthetic construct
  misc_feature 1..432: note = derived and/or modified sequence opt4 from anti-HIV_cap256-119-044740_VR-Chain
  source 1..432: mol_type = other RNA
cagatgcacctggtggagagcggcggcggcgtggtgcagcccggcatgagcctgagactgagctgcgccgccagccagttcaacttcggcagcttcggcatgcactgggtgagacaggcccccggcaagggcctggagtgggtggccaccatcagctacgacggcaccaagaagtaccacagcgacagcgtgtggggcagactgagcatcagcagagacaacagcaagaacaccctgttcctgcagatgaacagcctgagaaccgaggacaccgccctgtacttctgcgtgagagaccagagagaggacgactgcgaggagtggtggagcgactactacgacttcggcaagaagctgccctgcagaaagagcagaggcctggccggcatcttcgacatctggggccacggcaccatggtgaccgtgagcagc

SEQ ID NO: 32492 - RNA, 432 nt, synthetic construct
  misc_feature 1..432: note = derived and/or modified sequence opt4 from anti-HIV_cap256-119-043790_VR-Chain
  source 1..432: mol_type = other RNA
ctgctgcagctggtggagagcggcggcggcgtggtgcagcccggcaacagcctgagactgagctgcgccgccgccggcttcaccttcagcgactacagcctgcactgggtgagacaggcccccggcaagggcctggagtgggtggccatgatcagcgacgacggcaacctggacttctacgccgccagcgtgaagggcagattcaccatcagcagagacaacagcatcaacaccgtgtacctgcagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32493 - RNA, 432 nt, synthetic construct
  misc_feature 1..432: note = derived and/or modified sequence opt4 from anti-HIV_cap256-119-042880_VR-Chain
  source 1..432: mol_type = other RNA
gaggtgagactggtggagagcggcggcggcctggtgcagcccggcggcagcctgagactgagctgcgccgccagcggcttcaccctgagcgactactacatgagctggatcagacaggcccccggcaagggcctggagtgggtggccgccatcagcttcgccggcaccaagaagcactacggcaacagcgtgaagggcagattcaccatcagcagagacaacagcaagaacaccctgtacctggagatgaacagcctgagagtggaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32494 - RNA, 432 nt, synthetic construct
  misc_feature 1..432: note = derived and/or modified sequence opt4 from anti-HIV_cap256-119-042606_VR-Chain
  source 1..432: mol_type = other RNA
cagatgcagctggtggagagcggcggcggcgtggtgcagcccggcagaagcctgagactgagctgcgccgccagccagttcaccttcggcagctacggcatgcactgggtgagacagatccccggcaagggcctggagtgggtgaccggcatcagcttcgccgccaccaagacctactacggcgacagcgtgagaggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcatcctggacctgtggggccagggcaccatggtgaccgtgagcagc

SEQ ID NO: 32495 - RNA, 432 nt, synthetic construct
  misc_feature 1..432: note = derived and/or modified sequence opt4 from anti-HIV_cap256-119-042444_VR-Chain
  source 1..432: mol_type = other RNA
caggtgcagctggtggagagcggcggcgacgtggtgcaccccggcggcagcctgagactgagctgcgccgccagcggcttcaccttcagcagctacggcatccactgggtgagacaggcccccggcaagggcctggagtgggtggccgccatcagctacgacggcagcgacaagtaccacaccaacagcgtgtggggcagattcaccgtgagcagagacaacagcaagaacaccgtgtacctgcagatgaacagcctgagagccgaggacaccgccctgtacttctgcgtgagagacagaagagagagcgagtgcgagctgtgggagagcgactactacgacttcggcaagagactgccctgcgtgaagcccagaggcgtggccggcgtgttcgacatctggggccagggcaccatggtgaccgtgagcagc

SEQ ID NO: 32496 - RNA, 432 nt, synthetic construct
  misc_feature 1..432: note = derived and/or modified sequence opt4 from anti-HIV_cap256-119-040328_VR-Chain
  source 1..432: mol_type = other RNA
caggtgcagctggtggagagcggcggcggcgtggtgcagcccggcggcagcctgagactgagctgcgccgccagcggcttcaccttcagcagctacagcatgaactgggtgagacaggcccccggcaagggcctggagtgggtggccagcatcagcttcgccggcaccaagcagcactacggcaacagcgtgaagggcagattcaccatcagcagagacaacagcaagaacaccgtgtacctgcagatgaacagcctgagactggaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32497 - RNA, 432 nt, synthetic construct
  misc_feature 1..432: note = derived and/or modified sequence opt4 from anti-HIV_cap256-119-040164_VR-Chain
  source 1..432: mol_type = other RNA
cagatgcacctggtggagagcggcggcggcgtggtgcagcccggcatgagcctgagactgagctgcgccgccagccagttcaacttcggcagcttcggcatgcactgggtgagacaggcccccggcaagggcctggagtgggtggccaccatcagctacgacggcaccaagaagtaccacagcgacagcgtgtggggcagattcagcatcagcagagacaacagcaagaacaccctgtacctgcagatgaacagcctgagaaccgaggacaccgccctgtacttctgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32498 - RNA, 432 nt, synthetic construct
  misc_feature 1..432: note = derived and/or modified sequence opt4 from anti-HIV_cap256-119-039130_VR-Chain
  source 1..432: mol_type = other RNA
gaggagcagctggtggagagcggcggcggcctggtgcagcccggcagaagcctgagactgagctgcaccggcagcggcttcagattcggcgactacgccatgaactgggtgagacaggcccccggcaagggcctggagtgggtgaccttcatcagctacgacggcagcaacaagcactacgccgacagcgtgaagggcagattcaccgtgagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32499 - RNA, 432 nt, synthetic construct
  misc_feature 1..432: note = derived and/or modified sequence opt4 from anti-HIV_cap256-119-038138_VR-Chain
  source 1..432: mol_type = other RNA
caggtgcagctggtggagagcggcggcggcgtggtgcagaccggcagaagcctgagactgagctgcaccggcagccagttcaccttcggcagatacggcatgtactgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32500 - RNA, 432 nt, synthetic construct
  misc_feature 1..432: note = derived and/or modified sequence opt4 from anti-HIV_cap256-119-037868_VR-Chain
  source 1..432: mol_type = other RNA
caggtgcagctggtggagagcggcggcggcgtggtgcagcccggcagaagcctgagactgagctgcgccgccagccagttcaccttcagcaagtacggcatgcactgggtgagacaggcccccggcaagggcctgcagtgggtggccggcatcagctacgacggcagcgacaagtaccacgcccacttcgtgtggggcagattcagcatcagcagagacaacagcaagaacgccctgtacctgcagatgaacagcctgagaaccgaggacaccgccctgtacttctgcgtgagagacctgagagagagcgagtgcgaggagtggaagagcgactactacgacttcggcagaaagggcccctgcctgaagcccagaggcgtggccggcagcttcgacatctggggccagggcaccgtggtgaccgtgagcagc

SEQ ID NO: 32501 - RNA, 432 nt, synthetic construct
  misc_feature 1..432: note = derived and/or modified sequence opt4 from anti-HIV_cap256-119-037102_VR-Chain
  source 1..432: mol_type = other RNA
caggtgaagctggtggagagcggcggcggcgtggtgcagcccggcaagagcctgagactgagctgcaccgccagccagttcaccttcagcaacttcggcatgcactgggtgagacaggcccccggcaagggcctggagtgggtggccagcatcagcttcgtgggcatcaagaagcactacgccaacttcgtgagaggcagattcaccatcagcagagaccagagcaagaacaccctgtacctgcagatgaacagcgtgagagtggaggacaccgccagatactactgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32502 - RNA, 438 nt, synthetic construct
  misc_feature 1..438: note = derived and/or modified sequence opt4 from anti-HIV_cap256-119-036683_VR-Chain
  source 1..438: mol_type = other RNA
ggcgtgcagctggtggagagcggcggcgccgtggtgagacccggcggcagcctgaccctgagctgcgccgccagccagttcatcctgagcagctacggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32503 - RNA, 432 nt, synthetic construct
  misc_feature 1..432: note = derived and/or modified sequence opt4 from anti-HIV_cap256-119-036495_VR-Chain
  source 1..432: mol_type = other RNA
caggtgcagctggtggagagcggcggcggcgtggtgcagcccggcagaagcctgagactgagctgcgccgccagcggcttcagcttcagcagctacggcatgcactgggtgagacaggcccccggcaagggcctggagtgggtggccagcatcagcttcgtgggcatcaagacccactacgccaacagcgtgagaggcagattcaccatcagcagagaccagagcaagaacaccctgtacctgcagatgaacagcgtgagaatcgaggacaccgccagatacttctgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32504 - RNA, 438 nt, synthetic construct
  misc_feature 1..438: note = derived and/or modified sequence opt4 from anti-HIV_cap256-119-035375_VR-Chain
  source 1..438: mol_type = other RNA
gaggtgcagctggtggagagcggcggcggcctggtgcagcccggcagaagcctgagactgagctgcgccgccagcggcttcaccctggaggactacggcatgcactgggtgagacaggcccccggcaagggcctggagtgggtggccagcatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32505 - RNA, 438 nt, synthetic construct
  misc_feature 1..438: note = derived and/or modified sequence opt4 from anti-HIV_cap256-119-035165_VR-Chain
  source 1..438: mol_type = other RNA
caggtgcacctggtggagagcggcggcggcgtgggccagcccgccagaagcctgagactgagctgcgccgccagcggcttcatcctgagcagctacggcctgcactgggtgagacaggcccccggcaagggcctggagtgggtggccctgatcagctacgacggcaacaacgagtactacgccgagagcgtgtggggcagattcaccatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32506 - RNA, 432 nt, synthetic construct
  misc_feature 1..432: note = derived and/or modified sequence opt4 from anti-HIV_cap256-119-035109_VR-Chain
  source 1..432: mol_type = other RNA
caggtgcagctggtggagagcggcggcggcgtggtgcagcccggcagaagcctgagactgagctgcgccaccgccggcttcaccttcagcagctacgccatgcactgggtgagacaggcccccggcaagggcctggagtgggtggccagcatcagctacgacggcagcgacaagtaccacgccgacctggtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32507 - RNA, 339 nt, synthetic construct
  misc_feature 1..339: note = derived and/or modified sequence opt4 from anti-HIV_cap256-119-033789_VR-Chain
  source 1..339: mol_type = other RNA
caggtgtacctggtggagagcggcggcggcgtggtgcagcccggcagaagcctgagactgagctgcgccgccagccacttcagcctgagcagctacggcatgcactgggtgagacaggcccccgacatcagcaagaacaccctgtacctgcaggtgaacagcctgagacccgaggacaccgccatgtactactgcgccagagaccagagatactacgagtgcgaggagtgggccagcgactactacgacttcggcaaggagcagccctgcctggaccccagaggcgtggtgggcatcttcgacatctggggccagggcaccatggtgaccgtgagcagc

SEQ ID NO: 32508 - RNA, 432 nt, synthetic construct
  misc_feature 1..432: note = derived and/or modified sequence opt4 from anti-HIV_cap256-119-033641_VR-Chain
  source 1..432: mol_type = other RNA
caggtgcagctggtggagagcggcggcggcgtggtgcagaccggcagaagcctgagactgagctgcaccggcagccagttcaccttcggcagatacggcatgtactgggtgagacaggcccccggcaagggcctggagtgggtggccgccatcagctacgacggcagcgacaagtaccacaccaacagcgtgtggggcagattcaccgtgagcagagacaacagcaagaacaccgtgtacctgcagatgaacagcctgagagccgaggacaccgccctgtacttctgcgtgagagacagaagagagagcgagtgcgagctgtgggagagcgactactacgacttcggcaagagactgccctgcgtgaagcccagaggcgtggccggcgtgttcgacatctggggccagggcaccatggtgaccgtgagcagc

SEQ ID NO: 32509 - RNA, 432 nt, synthetic construct
  misc_feature 1..432: note = derived and/or modified sequence opt4 from anti-HIV_cap256-119-032113_VR-Chain
  source 1..432: mol_type = other RNA
caggtgcagctggtggagagcggcggcggcgtggtgcagcccggcagacccctgagactgagctgcgtgggcagcggcttcagcttcatcaccagcgccatgcactgggtgagacaggcccccgacaagggcctggagtgggtggccatcatcagcgacggcggcaacaacagacactacgccgacagcgtgaagggcagattcaccatcagcagagacaacagcaagaacaccgtgttcctggaggtgaacaacctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32510 - RNA, 432 nt, synthetic construct
  misc_feature 1..432: note = derived and/or modified sequence opt4 from anti-HIV_cap256-119-031739_VR-Chain
  source 1..432: mol_type = other RNA
caggtgcagctggtggagagcggcggcggcgtggtgcagcccggcagaagcctgagaatcagctgcgccgccagccagttcaccttcaacagatacggcatgcactgggtgagacaggcccccggcaagggcctggagtgggtggccagcatcagctacgacggcagcgacaagtaccacgccggcctggtgtggggcagattcatcatcagcagagacaacagcaagaacaccctgtacctgcagatgaacagcctgagagccgaggacaccgccctgtactactgcgtgagagacgagagagagagcgagtgcgagctgtgggagagcgactactacgacttcggcaagaagctgccctgcgtgaagcccagaggcgtggccggcaccctggacatctggggccagggcaccagagtgaccgtgagcagc

SEQ ID NO: 32511 - RNA, 432 nt, synthetic construct
  misc_feature 1..432: note = derived and/or modified sequence opt4 from anti-HIV_cap256-119-030932_VR-Chain
  source 1..432: mol_type = other RNA
gaggtgcagctgctggagagcggcggcggcgtggtgcagcccggcagaagcctgagactgagctgcgccgccagcggcttcgccttcagccactacggcatcttctgggtgagacaggcccccggcaagggcctggagtgggtgaccgtgatcagcggcgacggcagcacccagtggtacgccgacagcgtgcagggcagattcaccatcagcagagacagcagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32512 - RNA, 438 nt, synthetic construct
  misc_feature 1..438: note = derived and/or modified sequence opt4 from anti-HIV_cap256-119-030740_VR-Chain
  source 1..438: mol_type = other RNA
caggtgcagctggtggagttcggcggcggcgtggtgcagaccggcagaagcctgagactgagctgcgccgccagcggcttcaccttcagcgactacggcatgcactgggtgagacaggcccccggcaagggcctggagtgggtggccagcatcagcaacgacggcagcaagaagtaccacggcgacagcgtgtgggccagattcatcatcagcagagacaacagcaagaacaccctgttcctgcagatgagcagcctgagagccgaggacaccgccctgtacttctgcgtgagagaccacagagaggacgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32513 - RNA, 438 nt, synthetic construct
  misc_feature 1..438: note = derived and/or modified sequence opt4 from anti-HIV_cap256-119-030197_VR-Chain
  source 1..438: mol_type = other RNA
caggtgcacctggtggagagcggcggcggcgtggtgcagcccggcaagagcctgagactgagctgcgccgccagccagttcaccttctgcagatacggcatgcactgggtgagacaggcccccggcaagggcctggagtgggtggccagcatcagcaacgacggcaccgacaagtaccacgccgacaacgtgtggggcagattcaccatcagcagagacaacagcaagaacaccctgtacctggagatgaacagcctgagaggcgaggacaccgccctgtactactgcgccaaggacatgagagaggacgagtgcgaggagtggtggagcgactactacgacttcggcaaggagctgccctgcagaaagtggaagaccagaggcgtggccggcatcctggacaactggggccagggcaccatggtgaccgtgagcagc

SEQ ID NO: 32514 - RNA, 438 nt, synthetic construct
  misc_feature 1..438: note = derived and/or modified sequence opt4 from anti-HIV_cap256-119-027047_VR-Chain
  source 1..438: mol_type = other RNA
cagatgcagctggtggagagcggcggcggcgtggtgcagcccggcagaagcctgaccctgagctgcgccgccagccagttcaccttcagaaactacggcatgcactgggtgagacaggcccccggcaagggcctggagtgggtggccagcatcagcaaggacggcaccaagaagtaccacggcgacagcgtgtggggcagattcatcatcagcagagacaacagcaagaacaccctgttcctgcagatgagcagcctgagagccgaggacaccgccctgtacttctgcgtgagagaccagagagaggccgagtgcgaggagtggtggagcgactactacgacttcggcagagagctgccctgcagaaagttcagaggcctgggcctggccggcatcttcgacatctggggccacggcaccatggtgaccgtgagcagc

SEQ ID NO: 32515 - RNA, 432 nt, synthetic construct
  misc_feature 1..432: note = derived and/or modified sequence opt4 from anti-HIV_cap256-119-026950_VR-Chain
  source 1..432: mol_type = other RNA
caggtgcagctggtggagagcggcggcggcgtggtgcagcccggcaagagcctgagaatcagctgcgccgccagcagattcaccttcggcagattcggcatgcactgggtgagacaggcccccggcaagggcctggagtgggtggccagcatcagctacgacggcagcgacaagtaccacgccggcctggtgtggggcagattcatcatcagcagagacaacagcaagaacaccctgtacctgcagatgaacagcctgagagccgaggacaccgccctgtactactgcgtgagagacgagagagagagcgagtgcgagctgtgggagagcgactactacaacttcggcaagaactacccctgcgtgaagcccagaggcgtggccggcaccctggacatctggggccagggcaccaccgtgatcgtgagcagc

SEQ ID NO: 32516 - RNA, 438 nt, synthetic construct
  misc_feature 1..438: note = derived and/or modified sequence opt4 from anti-HIV_cap256-119-026279_VR-Chain
  source 1..438: mol_type = other RNA
cagatgcagctggtggagagcggcggcggcgtggtgcagcccggcaccagcctgaccctgagctgcgccgccagccagttcagcttcaccagctacggcatgcactgggtgagacaggcccccggcaagggcctggagtgggtggccagcatcagcaacgacggcaccaagaagtaccacgccgagagcgtgtggggcagattcaccatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatctggggccacggcaccgtggtgatcgtgagcagc

SEQ ID NO: 32517 - RNA, 432 nt, synthetic construct
  misc_feature 1..432: note = derived and/or modified sequence opt4 from anti-HIV_cap256-119-025355_VR-Chain
  source 1..432: mol_type = other RNA
gaggtgcagctggtggagagcggcggcggcctggtgcagcccggcagaagcctgagactgagctgcgccgccagcggcttcagcttcagcgactacgccatgcactgggtgagacaggcccccggccagggcctggagtgggtggccttcatcagctacgacggcaccaagaagtaccacagcgacagcgtgtggggcagactgaccatcagcagagacaacagcagaaacaccctgttcctgcagatgaacagcctgagaaccgaggacaccgccctgtacttctgcgtgagagaccagagagaggacgactgcgaggagtggtggagcgactactacgacttcggcaagaagctgccctgcagaaagagcagaggcctggccggcatcttcgacatctggggccacggcaccatggtgaccgtgagcagc

SEQ ID NO: 32518 - RNA, 432 nt, synthetic construct
  misc_feature 1..432: note = derived and/or modified sequence opt4 from anti-HIV_cap256-119-025301_VR-Chain
  source 1..432: mol_type = other RNA
caggtgcacctggtggccagcggcggcggcgtggtgccccccggcagaagcctgagactgagctgcgtggccagccagttcaccttcagcggcttcggcctgtactgggtgagacaggcccccggcaagggcctggagtgggtggccgccatcagcttcgccggcaccaagaagcactacgccaacagcgtgaagggcagattcaccatcagcagagacaacagcaagaacaccctgtacctgcagatgaacagcctgagacccgacgacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32519 - RNA, 438 nt, synthetic construct
  misc_feature 1..438: note = derived and/or modified sequence opt4 from anti-HIV_cap256-119-025010_VR-Chain
  source 1..438: mol_type = other RNA
caggtgcagctggtggagagcggcggcggcgtggtgcagcccggcagaagcctgagactgagctgccccgccagcggcttcagcttcagcacctacggcatgcactgggtgagacaggcccccggcaagggcctggagtgggtggccagcatcagcaacgacggcaacaagaagtaccacggcgagagcgtgtgggacagattcaccatcagcagagacaacagcaagaacaccctgttcctgcagatgaacagactgagagtggaggacaccgccctgtacttctgcgtgaaggaccagagagaggacgagtgcgaggagtggtggagcgactactacgacttcggcagagagctgccctgcagaaagttcagaggcctgggcctggccggcatcttcgacgtgtggggccacggcaccatggtgaccgtgagcagc

SEQ ID NO: 32520 - RNA, 432 nt, synthetic construct
  misc_feature 1..432: note = derived and/or modified sequence opt4 from anti-HIV_cap256-119-024631_VR-Chain
  source 1..432: mol_type = other RNA
caggtgcagctgatggagagcggcggcggcgtggtgcagcccggcggcagcctgagactgagctgcgccgccagcggcttcaccttcagcagctacggcatgcactgggtgagacaggcccccggcaagggcctggagtgggtggccggcatcagctacgacggcagcgacaagtaccacgcccacttcgtgtggggcagattcatcatcagcagagacaacagcaagaacgccctgtacctgcagatgaacagcctgagacccgaggacaccgccctgtacttctgcgtgagagacctgagagagagcgagtgcgaggagtggcagagctactactacgacttcggcagaaagggcccctgcctgaagcccagaggcgtggccggcagcttcgacatctggggccagggcaccgtggtgaccgtgagcagc

SEQ ID NO: 32521 - RNA, 432 nt, synthetic construct
  misc_feature 1..432: note = derived and/or modified sequence opt4 from anti-HIV_cap256-119-024467_VR-Chain
  source 1..432: mol_type = other RNA
gaggtgcagctggtggagagcggcggcggcctggtgcagcccggcggcagcctgaacgtgagctgcgccgccagcggcttcaccttcagaacctacgccatgcactgggtgagacaggcccccggcaagggcctggagtgggtggccgccatcagctacgacggcgacaacaagtacagcgccgacagcgtgaagggcagattcaccatcagcagagaccagagcaagaacaccctgtacctgcagatgaacagcgtgagagtggaggacaccgccagatactactgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32522 - RNA, 432 nt, synthetic construct
  misc_feature 1..432: note = derived and/or modified sequence opt4 from anti-HIV_cap256-119-023805_VR-Chain
  source 1..432: mol_type = other RNA
caggtgcagctggtggagagcggcggcggcgtggtgcagcccggcaagagcctgagactgagctgcgccgccagccagttcggcttcggcagctacggcatgcactgggtgagacaggcccccggcaagggcctggagtgggtggccaccatcagcttcgacggcgccgacaagtaccacgccgacgacgtgtggggcagattcagcatcagcagagacaacagcaagaacaccctgtacctgcagatgaacaacctgagacccgaggacaccgccctgtactactgcgccaaggacctgagagaggacgagtgcgaggagagatggagcgactactacgacttcggcaagcagctgccctgcagaaagagcagaggcgtggccggcgtgttcgacaactggggccagggcaccatggtgaccgtgagcagc

SEQ ID NO: 32523 - RNA, 432 nt, synthetic construct
  misc_feature 1..432: note = derived and/or modified sequence opt4 from anti-HIV_cap256-119-021736_VR-Chain
  source 1..432: mol_type = other RNA
caggtgcagctggtggagagcggcggcggcgtggtgcagcccggcagaagcgtgagactgagctgcgtggccagccagttcagcttcgacagatacggcatgcactgggtgagacaggcccccggcaagggcctggagtgggtggccagcatcagctacgacggcaccgacaagtaccacgccgacaaggtgtggggcagattcaccatcagcagagacaacagcaagaagaccctgtacctgcagatgaacagcctgagacccgaggacgccgccctgtactactgcgccaaggacctgagagaggacgagtgcgaggagtggtggagcgactactacgacttcggcaagcagctgccctgcagaaagagcagaggcgtggccggcatcttcgacagctggggccagggcaccatggtgaccgtgagcagc

SEQ ID NO: 32524 - RNA, 438 nt, synthetic construct
  misc_feature 1..438: note = derived and/or modified sequence opt4 from anti-HIV_cap256-119-021203_VR-Chain
  source 1..438: mol_type = other RNA
cagatgcagctggtggagagcggcggcggcgtggtgcagcccggcagaagcctgaccctgagctgcgccgccagccagttcaccttcagcaactacggcatgcactgggtgagacaggcccccggcaagggcctggagtgggtggccagcgtgagcaacgacggcaccaagaagtaccacggcgacagcgtgtgggacagattcaccatcagcagagacaacagcaagaacaccctgttcctgcagatgagcagcctgagagccgaggacaccgccgtgtacttctgcgtgagagacgagagagaggacgagtgcgaggagtggtggagcgactactacgacttcggcagagagctgccctgcagaaagttcagaggcctgggcctggccggcatcttcgacatctggggccacggcaccctggtgaccgtgagcagc

SEQ ID NO: 32525 - RNA, 432 nt, synthetic construct
  misc_feature 1..432: note = derived and/or modified sequence opt4 from anti-HIV_cap256-119-020569_VR-Chain
  source 1..432: mol_type = other RNA
caggtgcagctggtggagagcggcggcggcgtggtgcagcccggcgagagcctgagaatcagctgcgccgccagccagttcaccttcagcagatacggcatgcactgggtgagacaggcccccggcaagggcctggagtgggtggccagcatcagcttcgacggcagagacaagtaccacagcagcctggtgtggggcagactgaccatcagcagagacaacagcaagagcaccctgttcctgcagatgaacagcctgagacccgaggacaccgccctgtactactgcgccagagacgtgagagagagcgagtgcgaggagtggcagagcgactactacgccttctacagaaagctgccctgcgtgaagcccagaggcgtggccggcaccctggacatctggggccagggcaccatggtgaccgtgagcagc

SEQ ID NO: 32526 - RNA, 432 nt, synthetic construct
  misc_feature 1..432: note = derived and/or modified sequence opt4 from anti-HIV_cap256-119-019432_VR-Chain
  source 1..432: mol_type = other RNA
caggtgcagctggtgcagagcggcggcggcgtggtgcagcccggcagaagcctgagaatcagctgcgccgccccctacttcaccttcggcagatacggcttccactgggtgagacaggcccccggcaagggcctggagtgggtggccagcatcagcttcgacggcagagactactaccacagcccccacgtgtggggcagactgaccatcagcagagacaacagcaagaacaccctgtacctgcagatgaacagcctgagagccgaggacaccgccctgtactactgcgccagagacctgagagagagcgagtgcgaggagtgggagagcgactactacgacttcggcaagaagggcccctgcgtgaagcccagaggcgtggccggcagcctggacatgtggggccagggcaccatggtgaccgtgagcagc

SEQ ID NO: 32527 - RNA, 432 nt, synthetic construct
  misc_feature 1..432: note = derived and/or modified sequence opt4 from anti-HIV_cap256-119-018827_VR-Chain
  source 1..432: mol_type = other RNA
caggcccagctggtggagagcggcggcggcgtggtgcagcccggcagaagcctgagactgagctgcgccgccagccacttcagcttcaacagatacggcatgcactgggtgagacaggcccccggcaagggcctggagtgggtggccggcatcagctacgacggcagagacttctaccacgccgacatcgtgtggggcagactgaccatcagcagagacaacagcaagaacaccgtgtacctgcagatgaacagcctgagagccgacgacaccggcctgtactactgcgccagagacgtgagagagagcgagtgcgaggagtgggagagctactactacgacttcggcagaaagggcccctgcctgaagcccagaggcgtggccggcaccttcgacatgtggggccagggcaccatcgtgagcgtgagcgcc

SEQ ID NO: 32528 - RNA, 432 nt, synthetic construct
  misc_feature 1..432: note = derived and/or modified sequence opt4 from anti-HIV_cap256-119-018483_VR-Chain
  source 1..432: mol_type = other RNA
ctggtgcagctggtggagagcggcggcggcgtggtgcagcccggcaagagcctgagactgagctgcgtggccagccagttcaccttcaacagatacggcatgcactgggtgagacaggcccccggcaagggcctggagtgggtggccggcatcagctacgacggcagagacaagtaccacgcccacttcgtgtggggcagaatcaccatcagcagagacaacagcaagaacaccctgtacctgcagatgaacagcctgagagccgaggacaccgccctgtaccactgcgtgagagacctgagagagagcgagtgcgagctgtgggagagcgactactacgacttcggcaagaagctgccctgcgtgaagcccagaggcgtggccggcatcttcgacctgtggggccagggcaccatggtgaccgtgagcagc

SEQ ID NO: 32529 - RNA, 432 nt, synthetic construct
  misc_feature 1..432: note = derived and/or modified sequence opt4 from anti-HIV_cap256-119-018118_VR-Chain
  source 1..432: mol_type = other RNA
caggtgcacctggtggccagcggcggcggcgtggtgccccccggcagaagcctgaccctgagctgcgtggccagccagttcaccttcagcggctgcggcctgcactgggtgagacaggcccccggcaagggcctggagtgggtggccagcatcagcttcgccggcaccaagaagcactacggcaacagcgtgaagggcagattcaccatcagcagagacaacagcaagaacaccctgtacctgcagatgaacagcctgagacccgaggacaccgccctgtactactgcgccaaggacctgagagagtacgagtgcgaggagtggaccagcgactactacgacttcggcagagaccagccctgcatcgacagcagaggcgtggtgggcatcctggacatctggggccagggcaccatggtgaccgtgagcagc

SEQ ID NO: 32530 - RNA, 432 nt, synthetic construct
  misc_feature 1..432: note = derived and/or modified sequence opt4 from anti-HIV_cap256-119-017782_VR-Chain
  source 1..432: mol_type = other RNA
caggtgcagctggtggagagcggcggcggcgtggtgcagcccggcaagagcctgagactgagctgcgccgccagcggcttccccttcagcaactacgccatgcactgggtgagacagacccccggcagaggcctggagtgggtggccggcatcagcttcgccgccaccaagaagtactacagacccagcgtgagaggcagattcaccgtgagcaccgacatcagcaagaacaccctgtacctggagatgaacagcctgagacccgaggacaccgccctgtacttctgcgccagagaccagagatactacgagtgcgaggagtgggccagcgactactacgacttcggcagagagcagccctgcctggaccccagaggcgtggtgggcatcttcgacctgtggggccagggcaccatggtgaccgtgagcagc

SEQ ID NO: 32531 - RNA, 432 nt, synthetic construct
  misc_feature 1..432: note = derived and/or modified sequence opt4 from anti-HIV_cap256-119-017669_VR-Chain
  source 1..432: mol_type = other RNA
caggtgcagctggtggagagcggcggcggcgtggtgcagcccggcagcagcctgagactgagctgcgccgccagccacttcgccttcaacagatacggcatgcactgggtgagacaggcccccggcaagggcctggagtgggtggccggcatcagcttcgacggcgccgacaagttccacgccgacaaggtgtggggcagattcaccatcagcagagacaacagcaagaacaccctgagcctgcagatgaacagcctgagacccgaggacaccgccctgtactactgcgccaaggacctgagagaggacgagtgcgaggagtggtggagcgactactacgacttcggcagaagactgccctgcagaaagagcagaggcgtgagcggcatcttcgacaactggggccagggcaccatggtgaccgtgagcagc

SEQ ID NO: 32532 - RNA, 432 nt, synthetic construct
  misc_feature 1..432: note = derived and/or modified sequence opt4 from anti-HIV_cap256-119-016976_VR-Chain
  source 1..432: mol_type = other RNA
caggtgcagctggtggagagcggcggcggcgtggtgcagcccggcagaagcctgagactgagctgcgccgccagccagttcagcttcggcgacttcggcatgcactgggtgagacaggcccccggcaagggcctggagtgggtggccgccatcagcttcgccggcaccaagaagaactacgccgacagcgtgagaggcagattcaccatcagcagagacagcagcaagaacaccctgtacctgcagatgaacagcctgagacccgaggacaccgccctgtactactgcgtgaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32533 - RNA, 432 nt, synthetic construct
  misc_feature 1..432: note = derived and/or modified sequence opt4 from anti-HIV_cap256-119-015432_VR-Chain
  source 1..432: mol_type = other RNA
gaggtgcagctgctggagagcggcggcggcctggtgcagcccggcggcagcctgagactgagctgcgccgccagcggcttcaccttcagcggctacagcctgaactgggtgagacaggcccccggcaagggcctggagtgggtggccagcatcagctacgacggcagcgacaagtaccacgccgacagagtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32534 - RNA, 432 nt, synthetic construct
  misc_feature 1..432: note = derived and/or modified sequence opt4 from anti-HIV_cap256-119-015281_VR-Chain
  source 1..432: mol_type = other RNA
ctgggcagactggtggccagcggcggcggcgtggtgccccccggcagaagcctgagactgagctgcgtggccagccagttcaccttcagcggctgcggcctgcactgggtgagacaggcccccggcaagggcctggagtgggtggccagcatcagcttcgccggcaccaagaagcactacggcaacagcgtgaagggcagattcaccatcagcagagacaacagcaagaacaccgtgtacctggagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggggccagggcaccatggtgaccgtgagcagc

SEQ ID NO: 32535 - RNA, 432 nt, synthetic construct
  misc_feature 1..432: note = derived and/or modified sequence opt4 from anti-HIV_cap256-119-014957_VR-Chain
  source 1..432: mol_type = other RNA
caggtgcaggtggtggagagcggcggcggcgtggtgcagcccggcaccagcctgagactgagctgcaccgtgagcggcttcagcttcagcaactacgacctgcactgggtgagacagacccccgccaagggcctggagtgggtggccgtggtgagctacgacggcagcagagagtactacaccgacagcgtgaagggcagattcatcatcagcagagaccagagcaagaacaccctgtacctgcagatgaacagcgtgagactggaggacaccgccagatactactgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32536 - RNA, 432 nt, synthetic construct
  misc_feature 1..432: note = derived and/or modified sequence opt4 from anti-HIV_cap256-119-014777_VR-Chain
  source 1..432: mol_type = other RNA
caggtgcacctggtggagagcggcggcggcgtggtgcagcccggcagaagcctgagactgagctgcgccgccagccacttcagcctgagcagctacggcatgcactgggtgagacaggcccccggcaagggcctggagtgggtggccggcatcagcttcgccgccaccaagacctactacggcggcagcgtgaagggcagattcaccgtgagcagagacatcagcaagaacaccctgtacctgcagatgaacagcctgagacccgaggacaccgccatgtactactgcgccagagaccagagatactacgagtgcgaggagtgggccagcgactactacgacttcggcagagagcagccctgccaggaccccagaggcgtggtgggcgtgttcgacatgtggggccagggcaccatggtgaccgtgagcagc

SEQ ID NO: 32537 - RNA, 432 nt, synthetic construct
  misc_feature 1..432: note = derived and/or modified sequence opt4 from anti-HIV_cap256-119-014313_VR-Chain
  source 1..432: mol_type = other RNA
caggtgcagctggtggagagcggcggcggcgtggtgcagcccggcagaagcctgagaatcagctgcgccgccagccagttcaccttcagcagatacggcatgcactgggtgagacaggcccccggcaagggcctggagtgggtggccagcatcagctacgacggcagagactaccaccacgccggcgccgtgtggggcagattcatcatcagcagagacaacagcaagaacagcctgcacctgcagatgaacagcctgagacccgaggacaccgccctgtacttctgcgccagagacctgagagagagcgagtgcgaggagtgggagagcgactactacaacttctggaagaagctgccctgcgtgaagcccagaggcgtggtgggcatcctggacatctggggccagggcaccgtggtgaccgtgagcagc

SEQ ID NO: 32538 - RNA, 438 nt, synthetic construct
  misc_feature 1..438: note = derived and/or modified sequence opt4 from anti-HIV_cap256-119-014219_VR-Chain
  source 1..438: mol_type = other RNA
cagatgcagctggtggagagcggcggcggcgtggtgcagcccggcagcagcctgaccctgagctgcgccgccagccagttcaccttcagcaactacggcatgcactgggtgagacaggcccccggcaagggcctggagtgggtggccagcatcagcaacgacggcaccaagaagtaccacggcgacagcgtgtgggacagattcaccatcagcagagacaacagcaagaacaccctgttcctgcagatgaacagcctgagagccgaggacaccgccctgtacttctgcgtgaaggaccagagagaggacgagtgcgaggagtggtggagcgactactacgacttcggcagagagctgccctgcagaaagttcagaggcctgggcctggccggcaccttcgacatctggggccacggcaccatgctgatcgtgagcagc

SEQ ID NO: 32539 - RNA, 432 nt, synthetic construct
  misc_feature 1..432: note = derived and/or modified sequence opt4 from anti-HIV_cap256-119-013631_VR-Chain
  source 1..432: mol_type = other RNA
caggtgcagctggtggagagcggcggcggcgtggtgcagcccggcagaagcctgagactgagctgcgccgccagccagttcaccttcggcagctacggcatgcactgggtgagacagatccccggcaagggcctggagtgggtggccaccatcagctacgacggcaccaagaagtaccacgccgacagcgtgtgggacagattcatcatcagcagagacaacagcaagaacaccctgttcctgcagatgaacagcctgagacccgaggacaccgccctgtacttctgcgtgaaggaccagagacaggacgagtgcgaggagtggtggagcgactactacgacttcggcagaagactgccctgcagaaagagcagaggcctggccggcatcttcgacgtgtggggccacggcaccatggtgaccgtgagcagc

SEQ ID NO: 32540 - RNA, 432 nt, synthetic construct
  misc_feature 1..432: note = derived and/or modified sequence opt4 from anti-HIV_cap256-119-012924_VR-Chain
  source 1..432: mol_type = other RNA
caggtgaccctggtggagagcggcggcggcttcgtgcagcccggcggcagcctgagactgagctgcgccaccagcggcttcaccttcagcagctacgccatgcactgggtgagacaggcccccggcaagggcctggagtgggtggccgccatcagcttcgacggcgccgacaagtaccacgccgacaacgtgtggggcagactgagcatcagcagagacaacagcaagagcaccctgtacctgcagatgaacagcctgagacccgaggacaccgccgtgtacttctgcgccaaggacctgagagaggacgagtgcgaggagagatggagcgactactacgacttcggcaagcagctgccctgcagaaagagcagaggcgtggccggcatcttcgacaactggggccagggcaccatggtgaccgtgagcgcc

SEQ ID NO: 32541 - RNA, 432 nt, synthetic construct
  misc_feature 1..432: note = derived and/or modified sequence opt4 from anti-HIV_cap256-119-011793_VR-Chain
  source 1..432: mol_type = other RNA
caggtgcagctggtggagagcggcggcggcgtggtgcagcccggcggcagcctgagactgagctgcgtggccagccagttcaccttcagcagatacggcatgcactgggtgagacaggcccccggcaagggcctggagtgggtggccagcatcagctacgacggcagagacaagtaccacgccgacttcgtgtggggcagactgaccatcagcagagacgacagcaagaagaccctgtacctgcagatggacagcctgagagtggacgacaccgccctgtactactgcgtgagagacatgagagagagcgagtgcgagctgtgggagagcgactactacgacttcggcaagagactgccctgcgtgaagcccagaggcgtggccggcatcttcgacatctggggccagggcaccatggtgaccgtgagcagc

SEQ ID NO: 32542 - RNA, 432 nt, synthetic construct
  misc_feature 1..432: note = derived and/or modified sequence opt4 from anti-HIV_cap256-119-011413_VR-Chain
  source 1..432: mol_type = other RNA
caggtgcagctggtggagagcggcggcgacgtggtgcagcccggcagaagcctgagactgagctgcgccgccagcggcttcaccttcagcacctacggcatgcactgggtgagacaggcccccggcaagggcctggagtgggtggccgccatcagcttcgccggcaccaagaagaactacgccgacagcgtgagaggcagattcaccatcagcagagacagcagcaagaacaccctgtacctggagatgaacagcctgagacccgaggacaccgccctgtactactgcgccaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32543 - RNA, 432 nt, synthetic construct
  misc_feature 1..432: note = derived and/or modified sequence opt4 from anti-HIV_cap256-119-011323_VR-Chain
  source 1..432: mol_type = other RNA
caggtgaagctggtggagagcggcggcggcgtggtgccccccggcaagagcctgagactgagctgcaccgccagccagttcaccttcagcaacttcggcatgcactgggtgagacaggcccccggcaagggcctggagtgggtggccagcatcagcttcgtgggcatcaagacccactacgccaacagcgtgagaggcagattcaccatcagcagagaccagagcaagaacaccctgtacctgcagatgaacagcgtgagagtggaggacaccggcagatactactgcgccagagacatgagagagtacgagtgcgagctgtgggccagcgactactacgacttcggcaagccccagccctgcgaggaccccagaggcgtggtgggcaccttcgacatgtggggcctgggcaccctggtgaccgtgagcagc

SEQ ID NO: 32544 - RNA, 432 nt, synthetic construct
  misc_feature 1..432: note = derived and/or modified sequence opt4 from anti-HIV_cap256-119-011233_VR-Chain
  source 1..432: mol_type = other RNA
caggtgcacctggtggagagcggcggcggcgtggtgcagcccggcagaagcgtgagactgagctgcgccgccagccacttcagcctgagcagctacggcatgcactgggtgagacaggcccccggcaagggcctggagtgggtgaccggcatcagcttcgccggcaccaagacctactacggcgacagcgtgagaggcagattcaccgtgagcagagacatcagcaagaacaccctgttcctgcagatgaacagcctgagacccgacgacaccgccatgtactactgcgccagagaccagagatactacgagtgcgaggagtgggccagcgactactacgacttcggcagagagcagccctgcctggaccccagaggcgtggtgggcatcttcgacctgtggggccagggcaccatggtgaccgtgagcagc

SEQ ID NO: 32545 - RNA, 432 nt, synthetic construct
  misc_feature 1..432: note = derived and/or modified sequence opt4 from anti-HIV_cap256-119-009038_VR-Chain
  source 1..432: mol_type = other RNA
caggagcagctggtggagagcggcggcggcgtggtgcagcccggcagaagcctgagactgagctgcgtggccagcagattcaccttcagcgccttcggcatgcactgggtgagacaggcccccggcaagggcctggagtgggtggccagcatcagcttcgccggcatcaagaagtactacggcgacagcgtgaagggcagattcaccatcagcagagacaacagcaagaacaccctgtacctgcagatggacggcctgagaggcgaggacaccgccctgtactactgcgccaaggacctgagagagctggagtgcgaggagtgggccagcgactactacgacttcggcagaccccagccctgcctggaccccagaggcgtgagcggcatcagcaacgtgtggggccagggcaccatggtgaccgtgagcagc

SEQ ID NO: 32546 - RNA, 432 nt, synthetic construct
  misc_feature 1..432: note = derived and/or modified sequence opt4 from anti-HIV_cap256-119-008756_VR-Chain
  source 1..432: mol_type = other RNA
caggtgcagctggtggagagcggcggcggcgtggtgcagcccggcaagagcctgagactgagctgcgtggtgagccagttcaccttcggcagatacggcatgcactgggtgagacaggcccccggcaagggcctggagtgggtggccagcatcagctacgacggcagcgacaagtaccacaccagcagcctgtggggcagattcatcgtgagcagagacaacagcaagaacaccctgtacctgcagatgaacagcctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32547 - RNA, 438 nt, synthetic construct
  misc_feature 1..438: note = derived and/or modified sequence opt4 from anti-HIV_cap256-119-008055_VR-Chain
  source 1..438: mol_type = other RNA
cagatgcagctggtggagagcggcggcggcgtggtgcagcccggcagaagcctgaccctgagctgcgccgccagccagttcagcttcgccaactacggcatgcactgggtgagacaggcccccggcaagggcctggagtgggtggccagcatcagcaacgacggcaccaagaagtaccacgaggagagcgtgtggggcagattcaccatcagcaaggacaacagcaagaacaccctgttcctgcagatgaacagcctgagaatcgaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32548 - RNA, 435 nt, synthetic construct
  misc_feature 1..435: note = derived and/or modified sequence opt4 from anti-HIV_cap256-119-006949_VR-Chain
  source 1..435: mol_type = other RNA
caggtgcacctggtggagagcggcggcggcgtggtgcagcccggcagaagcctgagactgagctgcgccgccagcggcttcagcgtgagcaacaactacatgaactgggtgagacaggcccccggcgagggcctggagtgggtggccctgatcagcttcgacggcagacagaaggacctggccgacagcgtgaagggcagattcgccatcagcagagacaacagcaagaacaccctgtacctgcagatgaacagcctgagactggaggacaccgccctgtactactgcgccagagacctgagagagctggactgcgaggagtggaccctgtacaactactacgacttcggcagcagaggcccctgcgtggaccccagaggcgtgggcggcagcttcgacgtgtggggccagggcaccatggtgaccgtgagcagc

SEQ ID NO: 32549 - RNA, 432 nt, synthetic construct
  misc_feature 1..432: note = derived and/or modified sequence opt4 from anti-HIV_cap256-119-006685_VR-Chain
  source 1..432: mol_type = other RNA
caggtgcagctggtggagagcggcggcggcgtggtgcagcccggcagaagcctgagagtgagctgcgccgccagccacttcaccttcagcagatacggcatgcactgggtgagacaggcccccggcaagggcctggagtgggtggccagcatcagctacgacggcagagacttctaccacgccagaagcgtgtggggcagattcaccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32550 - RNA, 432 nt, synthetic construct
  misc_feature 1..432: note = derived and/or modified sequence opt4 from anti-HIV_cap256-119-006015_VR-Chain
  source 1..432: mol_type = other RNA
caggtgcagctggtggagagcggcggcggcgtggtgcagcccggcaagagcctgagactgagctgcgccgccagcagattcaccttcaacagatacggcatgcactgggtgagacaggcccccggcaagggcctggagtgggtggccgccatcagcttcgacggcaccgacaagtaccacagcgacgacgtgtggggcagattcaccatcagcagagacaacagcaagaacaccctgtacctgcagatgaacagcctgagacccgaggacaccgccctgtactactgcgccaaggacctgcaggaggacgagtgcgaggagtggtggagcgactactacgacttcggcaagcagctgccctgcagaaagagcagaggcgtggccggcatcttcgacgactggggccagggcaccatggtgaccgtgagcagc

SEQ ID NO: 32551 - RNA, 432 nt, synthetic construct
  misc_feature 1..432: note = derived and/or modified sequence opt4 from anti-HIV_cap256-119-005841_VR-Chain
  source 1..432: mol_type = other RNA
caggtgcagctggtggagagcggcggcggcgtggtgcagcccggcagaagcctgagactgagctgcgccgccagccagttcagcttcggcaacttcggcatgcactgggtgagacaggcccccggcaagggcctggagtgggtggccgccatcagcttcgccggcaccaaggagaactacgccaacagcgtgagaggcagattcaccatcagcagagacaacagcaagaacaccctgtacctgcagatgaacagcctgagagccgaggacaccgccctgtactactgcaccaaggacatgagagagtacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32552 - RNA, 432 nt, synthetic construct
  misc_feature 1..432: note = derived and/or modified sequence opt4 from anti-HIV_cap256-119-005824_VR-Chain
  source 1..432: mol_type = other RNA
caggtgcagctggtggagagcggcggcggcgtggtgcagcccggcggcagcctgagactgagctgcgccgccagcggcttcaccttcagaagatacgccatgcactgggtgagacaggcccccggcaagggcctggagtgggtggccagcatcagctacgacggcagcgacaagtaccacaccagcagcctgtggggcagattcatcgtgagcagagacaacagcaagaacaccctgtacctgcagatgaacagcctgagacccgaggacaccgccctgtactactgcgtgagagacagaagagagagcgagtgcgaggagagatggagcgactactacgacttcggcaagcagctgccctgcgtgaagcccagaggcgtggccggcatcttcgacatctggggccagggcaccatggtgaccgtgagcagc

SEQ ID NO: 32553 - RNA, 432 nt, synthetic construct
  misc_feature 1..432: note = derived and/or modified sequence opt4 from anti-HIV_cap256-119-005494_VR-Chain
  source 1..432: mol_type = other RNA
caggtgagactggtggagagcggcggcggcgtggtgcagcccggcagaagcctgagaatcagctgcgccgccagccagttcatgttcaacaagtacggcatgcactgggtgagacaggcccccggcaagggcctggagtgggtggccagcatcagctacgacggcagcgacaagtaccacgccgacctggtgtggggcagattcaccatcagcagagacaacagcaagaacaccctgtacctgcagatgaacagcctgagagccgaggacaccgccctgtactactgcgtgagagacgccagagagagcgagtgcgagctgtgggagagcgactactacaacttcggcagaaagctgccctgcgtgaagcccagaggcgtggccggcaccctggacatctggggccagggcaccatggtgaccgtgagcagc

SEQ ID NO: 32554 - RNA, 432 nt, synthetic construct
  misc_feature 1..432: note = derived and/or modified sequence opt4 from anti-HIV_cap256-119-004949_VR-Chain
  source 1..432: mol_type = other RNA
caggtgcagctggtggagagcggcggcggcgtggtgcagcccggcagaagcctgagactgagctgcgccgccagcaagttcagcctgagcagctacggcatgcactgggtgagacaggcccccggcagaggcctggagtgggtggccggcatcagcttcgccgccaccaagaagtactacagacccagcgtgagaggcagattcaccgtgagcaccgacatcagcaagaacaccctgtacctggagatgaacagcctgagacccgaggacaccgccctgtacttctgcgccagagaccagagatactacgagtgcgaggagtgggccagcgactactacgacttcggcagagagcagccctgcctggaccccagaggcgtggtgggcatcttcgacctgtggggccagggcaccatggtgaccgtgagcagc

SEQ ID NO: 32555 - RNA, 432 nt, synthetic construct
  misc_feature 1..432: note = derived and/or modified sequence opt4 from anti-HIV_cap256-119-004422_VR-Chain
  source 1..432: mol_type = other RNA
cacgtgcagctggtggagagcggcggcggcgtggtgcagcccggcagaagcctgagactgagctgcgccgccagcggcctgagcttcagcagctacgccatgcactgggtgagacaggcccccggcaagggcctggagtgggtggccgtggtgagctacgacggcaccaccaagttctacgccgacagcgtgaagggcagattcaccatcagcagagacaacagcaagaacaccctgtacctgcagatgaacagcctgagaggcgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32556 - RNA, 432 nt, synthetic construct
  misc_feature 1..432: note = derived and/or modified sequence opt4 from anti-HIV_cap256-119-003932_VR-Chain
  source 1..432: mol_type = other RNA
caggtgcagctgctggagagcggcggcggcgtggtgcagcccggcggcagcctgagactgagctgcaaggccagccacttcagcttcgacagatacggcatgcactgggtgagacaggcccccggcaagggcctggagtgggtggccgccatcagcttcgacggcgccgacaagtaccacgccgacaacgtgtggggcagactgagcatcagcagagacaacagcaagagcaccctgtacctgcagatgaacagcctgagacccgaggacaccgccgtgtacttctgcgccaaggacctgagagaggacgagtgcgaggagagatggagcgactactacgacttcggcaagcagctgccctgcagaaagagcagaggcgtggccggcatcttcgacaactggggccagggcaccatggtgaccgtgagcgcc

SEQ ID NO: 32557 - RNA, 438 nt, synthetic construct
  misc_feature 1..438: note = derived and/or modified sequence opt4 from anti-HIV_cap256-119-003577_VR-Chain
  source 1..438: mol_type = other RNA
caggtgcagctggtggagagcggcggcggcggcgtgcagcccggcagaagcctgagactgagctgcgccgccagcggcttcaccttcagaagctacgccatgcactgggtgagacaggcccccggcaagggcctggagtgggtggccgtgatcagcaacgacggcaccaagaagtaccacgccgagagcgtgtgggacagattcagcatcagcaaggacaacagcaagaacaccctgttcctgcagatgaacagcctgagagtggaggacaccgccctgtacttctgcgtgaaggaccagagagaggacgagtgcgaggagtggtggagcgactactacgacttcggcagagagctgccctgcagaaagagcagaggcctgggcctggccggcatcttcgacatgtggggccacggcaccatggtgaccgtgagcagc

SEQ ID NO: 32558 - RNA, 432 nt, synthetic construct
  misc_feature 1..432: note = derived and/or modified sequence opt4 from anti-HIV_cap256-119-002155_VR-Chain
  source 1..432: mol_type = other RNA
ctgggcagactggtggccagcggcggcggcgtggtgccccccggcagaagcctgagactgagctgcgtggccagccagttcaccttcagcggctgcggcctgcactgggtgagacaggtgcccggcaagggcctggagtgggtggccagcatcagcttcgccggcaccaagacccactacggcaacagcgtgaagggcagattcagcatcagcagagacaacagcatcaacaccgtgtacctgcagatgaacagcctgagagccgaggacaccgccctgtactactgcgccaaggacctgagagagtacgagtgcgaggagtggaccagcgactactacgacttcggcagaccccagccctgcatcgacagcagaggcgtggtgggcatcctggacatctggagccagggcaccatggtgaccgtgagcagc

SEQ ID NO: 32559 - RNA, 432 nt, synthetic construct
  misc_feature 1..432: note = derived and/or modified sequence opt4 from anti-HIV_cap256-119-002017_VR-Chain
  source 1..432: mol_type = other RNA
caggtgcagctggtggagagcggcggcggcgtggtgcagcccggcagaagcctgagactgagctgcgccgccagcggcttcaccttcagctactacggcatccactgggtgagacaggcccccggcaagggcctggagtgggtggccagcatcagctacgacgagagagacttctaccacgccagaagcgtgtggggcagattcgccatcagcagagacaacagcaagaacaccctgcacctgcagatgaacagcctgagacccgaggacaccgccctgtacttctgcgccagagacctgagagagagcgagtgcgaggagtgggagagctactactacgacttcggcaagaagggcccctgcgtgaagcccagaggcgtggtgggcgtgctggacatctggggccagggcaccctggtgaccgtgagcagc

SEQ ID NO: 32560 - RNA, 432 nt, synthetic construct
  misc_feature 1..432: note = derived and/or modified sequence opt4 from anti-HIV_cap256-119-001312_VR-Chain
  source 1..432: mol_type = other RNA
caggtgcagctgatggagagcggcggcggcgtggtgcagcccggcagaagcctgagactggcctgcgccgccagcggcttcaccttcagcagctacgccatccactgggtgagacaggcccccggcaagggcctggagtgggtggccgccatcagcttcgccggcaccaagaagaactacgccgacagcgtgagaggcagattcaccatcagcagagacagcagcaagaacaccctgtacctggagatgaacagcctgagacccgaggacaccgccctgtactactgcgccaaggacatgagaggctacgagtgcgaggagtggaccagcgactactacgacttcggcagaccccagccctgcatcgacagcagaggcgtggtgggcaccttcgacgtgtggggccagggcaccatggtgaccgtgagcagc

SEQ ID NO: 32561 - RNA, 438 nt, synthetic construct
  misc_feature 1..438: note = derived and/or modified sequence opt4 from anti-HIV_cap256-119-001017_VR-Chain
  source 1..438: mol_type = other RNA
cagatgcagctggtggagagcggcggcggcgtggtgcagcccggcagaagcctgaccctgagctgcgccgccagccagttcagcttcaccaactacggcatgcactgggtgagacaggcccccggcaagggcctggagtgggtggccagcatcagcaacgacggcaacaagaagtaccacggcgagagcgtgtgggacagattcaccatcagcagagacaacagcaagaacaccctgttcctgcagatgaacagactgagagtggaggacaccgccctgtacttctgcgtgaaggaccagagagaggacgagtgcgaggagtggtggagcgactactacgacttcggcagagagctgccctgcagaaagttcagaggcctgggcctggccggcatcttcgacgtgtggggccacggcaccatggtgaccgtgagcagc

SEQ ID NO: 32562 - RNA, 432 nt, synthetic construct
  misc_feature 1..432: note = derived and/or modified sequence opt4 from anti-HIV_cap256-119-000594_VR-Chain
  source 1..432: mol_type = other RNA
caggtgcagctggtggagagcggcggcggcctggtgcagcccggcaccagcctgagactgagctgcgccgccagcgccttcaccttcaagaactacggcatgcactgggtgagacaggcccccggcaagggcctggactgggtggccagcatcagctacgacggcagagacaagtaccacagcagcctggtgtggggcagactgaccatcagcagagacaacagcaagagcaccctgttcctgcagatgaacagcctgagagccgaggacaccgccctgtactactgcgccagagacctgagagagagcgagtgcgaggagtggcagagcgactactacgccttctacaagaagctgccctgcgtgaagcccagaggcgtggccggcaccctggacatctggggccagggcaccatggtgaccgtgagcagc

SEQ ID NO: 32563 - RNA, 432 nt, synthetic construct
  misc_feature 1..432: note = derived and/or modified sequence opt4 from anti-HIV_cap256-059-241099_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgacggcagcaacaagtactacgtggacagcgtgcagggcagattcaccatcagcagagacaacagcaagaacaccatgttcctgcagatgaacagcctgagaaccgaggacaccgccgtgtactactgcgccagagacctgggcgagagcgaggtggaggagtgggccaccgactactacgacttcagcatcgcctaccccgtggagggccccagaggcgtggtgggcatcttcgacatctggggccagggcaccatggtgaccgtgagcagc

SEQ ID NO: 32564 - RNA, 432 nt, synthetic construct
  misc_feature 1..432: note = derived and/or modified sequence opt4 from anti-HIV_cap256-059-207529_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccggcatcagcttcgccggcatcaacaagtactacggcaacagcgtgaagggcagattcaccatcagcagagacaacagcagaaacaccctgtacctgcagatgaacagcctgagagccgaggacaccgccctgtactactgcgccagagacctgagagagatggagtgcgaggagtgggccagcgactactacgacttcggcagaggcggcccctgccaggaccccagaggcgtggtgggcaccttcgacatctggggccagggcaccatggtgaccgtgagcagc

SEQ ID NO: 32565 - RNA, 435 nt, synthetic construct
  misc_feature 1..435: note = derived and/or modified sequence opt4 from anti-HIV_cap256-059-205541_VR-Chain
  source 1..435: mol_type = other RNA
cagatgcagctggtggagagcggcggcggcgtggtgcagcccggcggcagcctgagactgagctgcgccgccagcggcttcagcttcagctactacgccatggactgggtgagacaggcccccggcaagggcctggagtgggtggccttcatcagcagcgacggcagcgacaagaactacgccgacagcgtgaagggcagattcaccatcagcagagacaacagcaagaacaccctgtacctgcagatgaacagcctgagagccgaggacaccgccgtgtactactgcgccaaggacgtgggcggccacaagaacgacgagtgggccaccaactactactacgacatcagcatcgcctaccccatccaggaccccagagccgtggccggcgccttcgacgtgtggggccagggcaccatggtgaccgtgagcagc

SEQ ID NO: 32566 - RNA, 432 nt, synthetic construct
  misc_feature 1..432: note = derived and/or modified sequence opt4 from anti-HIV_cap256-059-188439_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccgccatcagcttcgccggcatcaacaagtactacaccgacagcgtgaagggcagattcaccatcagcagagacaacagcaagaacaccctgtacctgcagatgaacagcctgagagccgaggacaccgccctgtactactgcgccaaggacctgagaggcttcgagtgcgaggagtgggccagcgactactacgacttcggcagagacctgccctgccaggaccccagaggcgtggtgggcaccttcgacgtgtggggccagggcaccaaggtgaccgtgagcagc

SEQ ID NO: 32567 - RNA, 432 nt, synthetic construct
  misc_feature 1..432: note = derived and/or modified sequence opt4 from anti-HIV_cap256-059-187234_VR-Chain
  source 1..432: mol_type = other RNA
caggtgcagctggtggagagcggcggcggcgtggtgcaggccggcagaagcctgagactgagctgcgccgccagccagttcaccttcggcagctacggcatgcactgggtgagacaggcccccggcaagggcctggagtgggtggccgccatcagcttcgccggcaccaagatccactacgccgacagcgtgaagggcagattcaccatcagcagagacaacagcaagaacgccctgtacctgcagatgcacagcctgagagccgaggacaccgccctgtactactgcgccaaggacctgagagagtacgagtgcgaggagtgggccagcgactactacgacttcggcagagaccagccctgccaggaccccagaggcgtggtgggcatcttcgacatctggggccagggcaccatggtgaccgtgagcagc

SEQ ID NO: 32568 - RNA, 432 nt, synthetic construct
  misc_feature 1..432: note = derived and/or modified sequence opt4 from anti-HIV_cap256-059-187047_VR-Chain
  source 1..432: mol_type = other RNA
caggtgcagctggtggagagcggcggcggcgtggtgcagcccggcagaagcctgagactgagctgcgccgtgagccagctgaccttcagcagctacggcatgcactgggtgagacaggcccccggcaagggcctggagtgggtggccgccatcagcttcgtgggcatcaagaagtactacgccgacagcgtgaagggcagattcaccatcagcagagacaacagcaagaacaccctgtacctgcagatgaacagcctgagagtggaggacaccgccctgtactactgcgccaaggacctgagagagtacgagtgcgaggagtgggccagcgactactacgacttcggcagagaccagccctgccaggacgccagaggcgtggtgggcaccagcgacatctggggccagggcaccatggtgaccgtgagcagc

SEQ ID NO: 32569 - RNA, 432 nt, synthetic construct
  misc_feature 1..432: note = derived and/or modified sequence opt4 from anti-HIV_cap256-059-186068_VR-Chain
  source 1..432: mol_type = other RNA
caggtgcagctggtggagagcggcggcggcgtggtgcagcccggcagaagcctgagactgagctgcgccgccagccagttcagcttcagcaactacggcatgcactgggtgagacaggcccccggcaagggcctggagtgggtggccggcatcagcttcgccgccaccaagaagtactacgccgacagcgtgaagggcagattcagcgtgagcagagacaacagcaagaacgccctgtacctgcagatgaacagcctgagagccgaggacaccgccctgtactactgcgccagagacctgagagactacgagtgcgaggagtgggccagcgactactacgacttcggcagagagtacccctgccaggaccccagaggcgtggtgggcaccttcgacatctggggccagggcaccatggtgaccgtgagcacc

SEQ ID NO: 32570 - RNA, 435 nt, synthetic construct
  misc_feature 1..435: note = derived and/or modified sequence opt4 from anti-HIV_cap256-059-182835_VR-Chain
  source 1..435: mol_type = other RNA
caggtgcagctggtggagagcggcggcggcctggtgcagcccggcagaagcctgagactgagctgcgccgccagcggcttcagcttcaacaacttcgccatggactgggtgagacaggcccccggcaagggcctggagtgggtggccttcgtgagcagcgacggcagcaacaagaactacgccgacagcgtgaagggcagattcatcatcagcagagacaacagcaagaacaccgtgtacctgcagatgaacagcctgagagtggaggacaccgccgtgtactactgcgccaaggacctgggcgccaacaaggacgacgagtgggccaccgactactactacgacctgagcgtggccagacccgtgcccgaccccagagccgtggtgggcgccttcgacgtgtggggccagggcaccatggtgaccgtgagcagc

SEQ ID NO: 32571 - RNA, 432 nt, synthetic construct
  misc_feature 1..432: note = derived and/or modified sequence opt4 from anti-HIV_cap256-059-176659_VR-Chain
  source 1..432: mol_type = other RNA
agagtgcagctggtggagagcggcggcggcgtggtgcagcccggcagaagcctgagactgagctgcgccgccagccagttcagcttcagcaactacggcatgcactgggtgagacaggcccccggcaagggcctggagtgggtggccggcatcagcttcgccgccatcaagaagtactacgccgacagcgtgaagggcagattcaccatcagcagagacaacagcaagaacgccctgtacctgcagatgaacagcctgagagccgaggacaccgccctgtactactgcgccagagacctgagagagtacgagtgcgaggagtgggccagcgactactacgacttcggcagagagctgccctgccaggaccccagaggcgtggtgggcaccttcgacacctggggccagggcaccatggtgaccgtgagcacc

SEQ ID NO: 32572 - RNA, 432 nt, synthetic construct
  misc_feature 1..432: note = derived and/or modified sequence opt4 from anti-HIV_cap256-059-172956_VR-Chain
  source 1..432: mol_type = other RNA
caggtgcagctggtggagagcggcggcggcgtggtgcagcccggcagaagcctgagactgagctgcgccgccagccagttcagcttcagcagctacggcatgcactgggtgagacaggcccccggcaagggcctggagtgggtggccgccatgagcttcgccggcaccaaccagtactacgccgccagcgtgaagggcagattcaccatcagcagagacaacagcaagaacaccctgtacctgcacatgaacagcctgagacccgaggacaccgccctgtactactgcgccagagacctgagagagtacgagtgcgaggagtgggccgccgactactacgacttcggcagagagtacccctgccaggaccccagaggcgtggtgggcatcttcgacgtgtggggccagggcaccctggtgaccgtgagcagc

SEQ ID NO: 32573 - RNA, 432 nt, synthetic construct
  misc_feature 1..432: note = derived and/or modified sequence opt4 from anti-HIV_cap256-059-171272_VR-Chain
  source 1..432: mol_type = other RNA
caggtgctgctggtggagagcggcggcggcgtggtgcagcccggcagaagcctgagactgagctgcgccgccagccagttcaccttcagcaactacggcatgcactgggtgagacaggcccccggcaagggcctggagtgggtggccgccatcagcttcgccggcatgaagaagtactacgccgacagcgtgaagggcagattcaccatcagcagagacaacagcaagaacaccctgtacctgcagatgaacagcctgagagccgaggacaccgccctgtactactgcgccaaggacctgagagagttcgagtgcgaggagtgggccagcgactactacgacttcggcagagcccagccctgccaggaccccagaggcgtggtgggcaccttcgacctgtggggccagggcaccatggtgaccgtgagcagc

SEQ ID NO: 32574 - RNA, 432 nt, synthetic construct
  misc_feature 1..432: note = derived and/or modified sequence opt4 from anti-HIV_cap256-059-168734_VR-Chain
  source 1..432: mol_type = other RNA
caggtgcagctggtggagagcggcggcggcgtggtgcagcccggcagaagcctgagactgagctgcaccgccagccagttcagcttcagcagctacggcatgcactgggtgagacaggcccccggcaagggcctggagtgggtggccgccatcagcttcgccggcaccaagaagtactacgtgggcaccgtgaagggcagattcaccatcagcagagacaacagcaagaacaccctgtacctgcagatgaacagcctgagagccgaggacaccgccctgtactactgcgccaaggacatgagagagtacgagtgcgaggagtgggccagcgactactacgacttcggcagagagtacccctgccaggaccccagaggcgtggtgggcaccttcgacatctggggccagggcaccatggtgaccgtgagcagc

SEQ ID NO: 32575 - RNA, 432 nt, synthetic construct
  misc_feature 1..432: note = derived and/or modified sequence opt4 from anti-HIV_cap256-059-155838_VR-Chain
  source 1..432: mol_type = other RNA
caggtgcagctggtggagagcggcggcggcgtggtgcagcccggcagaagcctgagactgagctgcgccgtgagccagttcaccttcagcaactacggcatgcactgggtgagacaggcccccggcaagggcctggagtgggtggccgccatcagcttcgccggcaccaagaagagctacgccgccagcgtgaagggcagattcaccatcagcagagacaacagcaagaacaccctgtacctgcagatgaacagcctgagacccgaggacaccgccctgtactactgcgccaaggacatgagaggcttcgagtgcgaggagtgggccagcgactactacgacttcggcagagagcagccctgccaggaccccagaggcgtggtgggcatcttcgacctgtggggccagggcaccatggtgagcgtgagcagc

SEQ ID NO: 32576 - RNA, 432 nt, synthetic construct
  misc_feature 1..432: note = derived and/or modified sequence opt4 from anti-HIV_cap256-059-149799_VR-Chain
  source 1..432: mol_type = other RNA
caggtgcacctggtggagagcggcggcggcgtggtgcagcccggcagaagcctgagactgagctgcgccgccagccagttcaccttcagcaactacggcttccactgggtgagacaggcccccggcaagggcctggagtgggtggccgccatcagcttcgccggcgtgaagaagcactacgccgacagcgtgaagggcagattcaccatcagcagagacaacagcaagaacaccctgtacctgcagctgaacagcctgagagccgaggacaccgccctgtactactgcgccaaggacctgagagagtacgagtgcgaggagtgggccagcgactactacgacttcggcagagacttcccctgccaggaccccagaggcgtggtgggcaccttcgacatctggggccagggcaccatggtgaccgtgagcagc

SEQ ID NO: 32577 - RNA, 432 nt, synthetic construct
  misc_feature 1..432: note = derived and/or modified sequence opt4 from anti-HIV_cap256-059-148168_VR-Chain
  source 1..432: mol_type = other RNA
caggtgcagctggtggagagcggcggcggcgtggtgcagcccggcagaagcctgagactgagctgcaccgccagccagttcaccttcagcaactacggcatgcactgggtgagacaggcccccggcaagggcctggagtgggtggccggcatcagcttcgccgccaccaagaagtactacagcgacagcgtgaagggcagattcaccatcagcagagacaacagcaagaacgccctgtacctgcagatgaacagcctgagagccgaggacaccgccctgtaccactgcgccaaggacctgagagagtacgagtgcgaggagtgggccagcgactactacgacttcggcagagagcagccctgccaggaccccagaggcgtggtgggcaccttcgacatctggggccagggcaccatggtgaccgtgagcacc

SEQ ID NO: 32578 - RNA, 435 nt, synthetic construct
  misc_feature 1..435: note = derived and/or modified sequence opt4 from anti-HIV_cap256-059-144685_VR-Chain
  source 1..435: mol_type = other RNA
caggtgcacctggtggagagcggcggcggcgtggtgcagcccggcagaagcctgagactgagctgcgccgccagcggcttcaccttcagcaacttcgccatggactgggtgagacaggcccccggcaagggcctggagtgggtggccttcgtgagcagcgacggcaacaacaagaactacggcgacagcgtgaagggcagattcaccatcagcagagacaacagcaagaacaccctgttcctgcagatgaacagcctgagagccgaggacaccgccctgtactactgcgtgaaggacgtgggcgactacaagagcgacgagtgggccacccactactactacgacctgagcatcgccgaccccatccaggaccccagagccgtggtgggcgccttcgacatctggggcagaggcaccatggtggccgtgagcagc

SEQ ID NO: 32579 - RNA, 432 nt, synthetic construct
  misc_feature 1..432: note = derived and/or modified sequence opt4 from anti-HIV_cap256-059-140017_VR-Chain
  source 1..432: mol_type = other RNA
caggtgcagctggtggagagcggcggcggcgtggtgcagcccggcagaagcctgagactgagctgcgccgccagccagttcagcttcggcaacttcggcatgcactgggtgagacaggcccccggcaagggcctggagtgggtggccggcatcagcttcgccggcaccaagaagtactacgccgacagcgtgaagggcagattcaccatcagcagagacaacagcaagagcgccctgttcctgcagatgaacagcctgagagccgaggacaccgccctgtactactgcgccaaggacctgagatactacgagtgcgaggagtgggccagcgactactacgacttcggcagagaccagccctgccaggaccccagaggcgtggtgggcaccttcgacatgtggggccagggcaccatggtgaccgtgagcagc

SEQ ID NO: 32580 - RNA, 432 nt, synthetic construct
  misc_feature 1..432: note = derived and/or modified sequence opt4 from anti-HIV_cap256-059-137547_VR-Chain
  source 1..432: mol_type = other RNA
caggtgcagctggtggagagcggcggcggcgtggtgcagcccggcagaagcctgagactgagctgcgccgccagccagttcaccttcagcagatacggcatgcactgggtgagacaggcccccggcaagggcctggagtgggtggccgccatcagcttcgccggcatcaagaagaactacgccgacagcgtgaagggcagattcaccatcagcagagacaacagcaagaacaccctgtacctgcagatgaacagcctgagagccgaggacaccgccctgtactactgcgccagagacctgagagagttcgagtgcgaggagtgggccagcgactactacgacttcggcagagacttcccctgccaggaccccagaggcgtggtgggcatcttcgacatctggggccagggcaccatggtgaccgtgagcagc

SEQ ID NO: 32581 - RNA, 435 nt, synthetic construct
  misc_feature 1..435: note = derived and/or modified sequence opt4 from anti-HIV_cap256-059-131908_VR-Chain
  source 1..435: mol_type = other RNA
caggtgcagctggtggagagcggcggcggcgtggtgcagcccggcagaagcctgagactgagctgcaccgccagcggcttcaccttcagcaactacggcatccactgggtgagacaggcccccggcaagggcctggagtgggtggccgccatcagctacgagggcagcatcaagtactacgtggacagcgtgaagggcagattcaccatcagcagagacgacagcaagaacaccctgttcctgcagatgaacagcctgagaaccgaggacaccgccgtgtactactgcaccagagacgtgagagagtgggagaccgaggagtgggccaccaactactactacgacctgagcatcgcctaccccatcagacaccccagaggcgtggtgggcatcttcgacgtgtggggcctgggcaccagagtgaccgtgagcagc

SEQ ID NO: 32582 - RNA, 432 nt, synthetic construct
  misc_feature 1..432: note = derived and/or modified sequence opt4 from anti-HIV_cap256-059-116006_VR-Chain
  source 1..432: mol_type = other RNA
caggcccagctggtggagagcggcggcggcgtggtgcagcccggcagaagcctgagactgagctgcgccgccagccagttcagcttcagcagctacggcatgcactgggtgagacaggcccccggcaagggcctggagtgggtggccagcatcagcttcgccggcgtgaagaagaccaacgccgacagcgtgaagggcagattcaccatcagcagagacaacagcaagaacaccctgcacctgcagatgaacggcctgagaaacgacgacaccgccctgtactactgcgccagagacctgagagacttcgagtgcgaggagtgggccagcgactactacgacttcggcagagagttcccctgccaggaccccagaggcgtggtgggcaccttcgacatctggggccagggcaccaaggtgaccgtgagcagc

SEQ ID NO: 32583 - RNA, 411 nt, synthetic construct
  misc_feature 1..411: note = derived and/or modified sequence opt4 from anti-HIV_cap256-059-115783_VR-Chain
  source 1..411: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagctacgccgacagcgtgaagggcagattcaccatcagcagagacaacagcaagaacaccctgtacctgcagatgaacagcctgagagccgaggacaccgccctgtactactgcgccaaggacctgagagagatggagtgcgaggagtgggccagcgactactacgacttcggcagagacctgccctgccaggaccccagaggcgtggtgggcaccctggacatctggggccagggcaccatggtgaccgtgagcagc

SEQ ID NO: 32584 - RNA, 432 nt, synthetic construct
  misc_feature 1..432: note = derived and/or modified sequence opt4 from anti-HIV_cap256-059-114609_VR-Chain
  source 1..432: mol_type = other RNA
caggtgcagctggtggagagcggcggcggcgtggtgcagcccggcagaagcctgagactgagctgcgccgccagccagctgaccttcagcaacttcggcatgcactgggtgagacaggcccccggcaagggcctggagtgggtggccggcatcagcttcgccggcaccaagaagtactacgccgacagcgtgaagggcagattcaccatcagcagagacaacagcaagaacgccctgtacctgcagatgaacaccctgagagccgaggacaccgccctgtacttctgcgccaaggacctgagagagtacgagtgcgaggagtgggccagcgactactacgacttcggcagagaccagccctgccaggaccccagaggcgtggtgggcatcttcgacatctggggccagggcaccatggtgaccgtgagcagc

SEQ ID NO: 32585 - RNA, 432 nt, synthetic construct
  misc_feature 1..432: note = derived and/or modified sequence opt4 from anti-HIV_cap256-059-113952_VR-Chain
  source 1..432: mol_type = other RNA
caggcccagctggtggagagcggcggcggcgtggtgcagcccggcagaagcctgagactgagctgcgccgccagccacttcaccttcagcagctacggcttccactgggtgagacaggcccccggcaagggcctggagtgggtggccggcatcagcttcgccgccaccaagaagtactacgccgacagcgtgaagggcagattcaccatcagcagagacaacagcaaggacgccctgtacctgcagatgaacagcctgagagccgaggacaccgccctgtactactgcgccagagacctgagaggctacgagtgcgaggagtgggccagcgactactacgacttcggcagagaccagccctgccaggaccccagaggcgtggtgggcatcttcgacctgtggggccagggcaccatggtgaccgtgagcagc

SEQ ID NO: 32586 - RNA, 432 nt, synthetic construct
  misc_feature 1..432: note = derived and/or modified sequence opt4 from anti-HIV_cap256-059-113878_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccctgatcagctacgacgccaccaacaagtactacgtggacagcgtgaagggcagattcaccatcagcagagacaacagcaagaacaccctgtacctgcagatgagcagcctgaccgccgaggacaccgccgtgtactactgcgccaaggacctgggcggcatcaagatcgacgagtggggcaccgactactacgacatcagcgtgagctaccccgtgcaggaccccagagccgtggccggcatcttcgacgtgtggggccacggcaccatggtgagcgtgagcagc

SEQ ID NO: 32587 - RNA, 432 nt, synthetic construct
  misc_feature 1..432: note = derived and/or modified sequence opt4 from anti-HIV_cap256-059-113622_VR-Chain
  source 1..432: mol_type = other RNA
caggtgcagctggtggagagcggcggcggcgtggtgcagcccggcagaagcctgagactgagctgcgccgccagccagttcaccttcaccagctacggcatgcactgggtgagacaggcccccggcaagggcctggagtgggtggccggcatcagcttcgccggcaccaagaagcactacgccgacagcgtgaagggcagattcaccatcagcagagacaacagcaagagcaccctgtacctgcagatgaacagcctgagagccgaggacaccgccctgtactactgcgccaaggacatgagagagtacgagtgcgaggagtgggccagcgactactacgacttcggcagagaccagccctgccaggaccccagaggcgtggtgggcatcttcgacctgtggggccagggcaccatggtgaccgtgagcagc

SEQ ID NO: 32588 - RNA, 432 nt, synthetic construct
  misc_feature 1..432: note = derived and/or modified sequence opt4 from anti-HIV_cap256-059-109427_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccagcatcagcttcgccggcatcaagaagcactacaccgacagcgtgaagggcagattcaccatcagcagagacaacagcaagaacaccctgttcctgcagatgaacagcctgagagccgaggacaccgccctgtactactgcgccagagacctgagagagtacgagtgcgaggagtgggccagcgactactacgacttcggcagagaccagccctgccaggaccccagaggcgtggtgggcaccagcgacatctggggccagggcaccaaggtgaccgtgagcagc

SEQ ID NO: 32589 - RNA, 432 nt, synthetic construct
  misc_feature 1..432: note = derived and/or modified sequence opt4 from anti-HIV_cap256-059-109081_VR-Chain
  source 1..432: mol_type = other RNA
caggagcagctggtggagagcggcggcggcgtggtgcagcccggcagaagcctgagactgagctgcgccgccagccagttcagcttcagcgcctacggcatgcactgggtgagacaggcccccggcaagggcctggagtgggtggccggcatcagcttcgccgccaccaagaagtactacgaggacagcgtgaagggcagattcaccatcagcagagacaacagcaagaacaccctgtacctgcagatgaacagcctgagaggcgaggacaccgccctgtactactgcgccaaggacatgagagagatggagtgcgaggagtgggccagcgactactacgacttcggcagaccccagccctgccaggaccccagaggcgtggtgggcatcttcgacatgtggggccagggcaccatggtgaccgtgagcagc

SEQ ID NO: 32590 - RNA, 432 nt, synthetic construct
  misc_feature 1..432: note = derived and/or modified sequence opt4 from anti-HIV_cap256-059-107590_VR-Chain
  source 1..432: mol_type = other RNA
caggagcagctggtggagagcggcggcggcgtggtgcagcccggcagaagcctgagactgagctgcgccgccagccagttcagcatcagcgcctacggcatgcactgggtgagacaggcccccggcaagggcctggagtgggtggccggcatcagcttcgccggcaccaagaagtactacgccgacagcgtgaagggcagattcaccatcagcagagacaacagcaagaacaccctgtacctgcagatgaacagcctgagaggcgaggacaccgccctgtactactgcgccaaggacatgagagagatggagtgcgaggagtgggccagcgactactacgacttcggcagagaccagccctgccaggaccccagaggcgtggtgggcatcttcgacatgtggggccagggcaccatggtgaccgtgagcagc

SEQ ID NO: 32591 - RNA, 435 nt, synthetic construct
  misc_feature 1..435: note = derived and/or modified sequence opt4 from anti-HIV_cap256-059-107504_VR-Chain
  source 1..435: mol_type = other RNA
caggtgctgctggtggagagcggcggcggcgtggtgcagcccggcaagagcctgagactgagctgcagcgccagcagattcaccttcagcaactacggcatgcactgggtgagacaggcccccggcaagggcctggagtgggtggccgccgtgagcttcgccggcatcaagaagaccaacgccgacagcgtgaagggcagattcaccatcagcagagacaacagcaagaacaccctgtacctgcagatgaacagcctgagagccgaggacaccgccctgtactactgcgccagagacctgagagacttcgagtgcgaggagtgggccagcgactactacgacttctggggcgacccccagccctgccaggaccccagaggcgtggtgggcaccttcgacctgtggggccagggcaccatggtgaccgtgagcagc

SEQ ID NO: 32592 - RNA, 432 nt, synthetic construct
  misc_feature 1..432: note = derived and/or modified sequence opt4 from anti-HIV_cap256-059-099614_VR-Chain
  source 1..432: mol_type = other RNA
gaggtgctgctgctggagagcggcggcggcctggtgcagcccggcagaagcctgagactgagctgcgccgccagccagttcaccttcagcagctacggcatgcactgggtgagacaggcccccggcaagggcctggagtgggtggccggcatcagcttcgtgggcatcaagaagtactacgccgacagcgtgaagggcagattcaccatcagcagagacaacagcaagaacaccctgtacctgcagatgaacagcctgagagccgaggacaccgccctgtactactgcgccagagacctgagagagtacgagtgcgaggagtgggccagcgactactacgacttcggcagagaccagccctgccaggaccccagaggcgtggtgggcaccttcgacatctggggccagggcaccatggtgaccgtgagcagc

SEQ ID NO: 32593 - RNA, 432 nt, synthetic construct
  misc_feature 1..432: note = derived and/or modified sequence opt4 from anti-HIV_cap256-059-098972_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccagcatcagcttcgccggcatcaagaagaactacagagacagcgtgaagggcagattcaccatcagcagagacaacagcaagaacaccctgtacctgcagatgaccagcctgagacccgaggacaccgccctgtactactgcgccaaggacctgagaggcttcgagtgcgaggagtgggccagcgactactacgacttcggcagagagctgccctgccaggaccccagaggcgtggtgggcaccttcgacatgtggggccagggcaccatggtgaccgtgagcagc

SEQ ID NO: 32594 - RNA, 432 nt, synthetic construct
  misc_feature 1..432: note = derived and/or modified sequence opt4 from anti-HIV_cap256-059-097236_VR-Chain
  source 1..432: mol_type = other RNA
caggtgcagctggtggagagcggcggcggcgtggtgcagcccggcagaagcctgagactgagctgcgccgccagcggcttcagcttcagcaacttcggcttccactgggtgagacaggcccccggcaagggcctggagtgggtggccgccatcagcttcgtgggcaacaagaagtactacgccgagagcgtgaagggcagattcaccatcagcagagagaacagcaagaacatgctgttcctgcagatgaacagcctgagaggcgaggacaccgccgtgtactactgcgccaaggacctgagagagttcgagtgcgaggagtgggccagcgactactacgacttcggcagagagcagccctgccaggaccccagaggcgtggtgggcagcatcgacgtgtggggccacggcagcctggtgaccgtgagcagc

SEQ ID NO: 32595 - RNA, 432 nt, synthetic construct
  misc_feature 1..432: note = derived and/or modified sequence opt4 from anti-HIV_cap256-059-091487_VR-Chain
  source 1..432: mol_type = other RNA
caggtgcagctggtggagagcggcggcggcgtggtgcagcccggcagaagcctgagactgagctgcgccgccagccagttcaccttcaacagatacggcatgcactgggtgagacaggcccccggcaagggcctggagtgggtggccgtgatcagctacgacggcaccaacaagtactacggcgagagcgtgaagggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcagagagctgccctgcagaaagagcagaggcgtggccggcatcttcgacatctggggccagggcaccatggtgaccgtgagcagc

SEQ ID NO: 32596 - RNA, 432 nt, synthetic construct
  misc_feature 1..432: note = derived and/or modified sequence opt4 from anti-HIV_cap256-059-089812_VR-Chain
  source 1..432: mol_type = other RNA
caggtgcagctggtggagagcggcggcggcgtggtgcagcccggcagaagcctgagactgagctgcgccgccagccagctgaccttcagcagctacggcatgcactgggtgagacaggcccccggcaagggcctggagtgggtggccggcatcagcttcgccggcaccaagaagcactacagcgacagcgtgaagggcagattcaccatcagcagagacaacagcaagaacgccctgtacctgcagatgaacagcctgagagccgaggacaccgccctgtactactgcgccaaggacctgagagagtacgagtgcgaggagtgggccagcgactactacgacttcggcagagagcagccctgccaggaccccagaggcgtggtgggcatcttcgacatgtggggccagggcaccatggtgaccgtgagcagc

SEQ ID NO: 32597 - RNA, 432 nt, synthetic construct
  misc_feature 1..432: note = derived and/or modified sequence opt4 from anti-HIV_cap256-059-088468_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgtgggcatcaagaagtactacgccaacagcgtgaagggcagattcaccatcagcagagacaacagcaagaacaccctgtacctgcagatgaacagcctgagagccgaggacaccgccctgtactactgcgccagagacctgagagagtacgagtgcgaggagtgggccagcgactactacgacttcggcagaggcggcccctgccaggaccccagaggcgtggtgggcagcttcgacatctggggccagggcaccatggtgaccgtgagcagc

SEQ ID NO: 32598 - RNA, 432 nt, synthetic construct
  misc_feature 1..432: note = derived and/or modified sequence opt4 from anti-HIV_cap256-059-088341_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgccggcatcaagaagcactacgccgacagcgtgaagggcagattcaccatcagcagagacaacagcaagaacatggtgttcctgcagatgaacagcctgagagccgaggacaccgccctgtactactgcgccagagacctgagagagtacgagtgcgaggagtgggccagcgactactacgacttcggcagagaccagccctgccaggaccccagaggcgtggtgggcaccagcgacatctggggccagggcaccatggtgaccgtgagcagc

SEQ ID NO: 32599 - RNA, 432 nt, synthetic construct
  misc_feature 1..432: note = derived and/or modified sequence opt4 from anti-HIV_cap256-059-086533_VR-Chain
  source 1..432: mol_type = other RNA
caggtgctgctggtggagagcggcggcggcgtggtgcagcccggcagaagcctgagactgagctgcgccgccagccagttcaccttcagcaacttcggcatgcactgggtgagacaggcccccggcaagggcctggagtgggtggccggcatcagcttcgtgggcatcaagaagtactacgccggcagcgtgaagggcagattcaccatcagcagagacaacagcaagaacaccctgtacctgcagatgaacagcctgagagccgaggacaccgccctgtactactgcgccaaggacctgagagagttcgagtgcgaggagtgggccagcgactactacgacttcggcagaccccagccctgccaggaccccagaggcgtggtgggcaccttcgacctgtggggcctgggcaccctggtgaccgtgagcagc

SEQ ID NO: 32600 - RNA, 432 nt, synthetic construct
  misc_feature 1..432: note = derived and/or modified sequence opt4 from anti-HIV_cap256-059-086043_VR-Chain
  source 1..432: mol_type = other RNA
gaggtgcacctggtggagagcggcggcggcctggtgaagcccggcggcagcctgagactgagctgcgccgccagcggcttcaccttcagcacctacagcatgaactgggtgagacaggcccccggcaagggcctggagtgggtggccttcgtggccttcgacgagagcgacaagtactacgccgacagcgtgaagggcagattcaccatcagcagagacaacagcaagaacaccctgagcctgcagatgaacagcctgagagtggaggacaccgccatctactactgcgccaaggaggtgggcgacaacaaggacgacgagtgggccagcgactactacgacctgagcatcgcctaccccatccaggaccccagagccgtgggcagaggctacgacatctggggccagggcaccatggtgaccgtgagcagc

SEQ ID NO: 32601 - RNA, 432 nt, synthetic construct
  misc_feature 1..432: note = derived and/or modified sequence opt4 from anti-HIV_cap256-059-084191_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgtgggcatcaagaagtactacgccgacagcgtgaagggcagattcaccgtgagcagagacaacagcaagagcaccctgtacctgcagatgaacagcctgagagccgaggacaccgccctgtactactgcgccagagacctgagagagtacgagtgcgaggagtgggccagcgactactacgacttcggcagagaccagccctgccaggaccccagaggcgtggtgggcatcttcgacatctggggccagggcaccgccgtgaccgtgagcagc

SEQ ID NO: 32602 - RNA, 417 nt, synthetic construct
  misc_feature 1..417: note = derived and/or modified sequence opt4 from anti-HIV_cap256-059-082135_VR-Chain
  source 1..417: mol_type = other RNA
caggtgcagctggtggagagcggcggcggcgtggtgcagcccggcagaagcctgagactgagctgcaccgccagcggcttcaccttcagaagctacgccatccactgggtgagacaggcccccggcaagggcctggagtgggtggccctgatcagctacgacggcagcaacaagtactacgccgacagcgtgaagggcagattcaccatcagcagagacaacagcaagaacaccctgtacctgcagatgaacagcctgaccagcgaggacaccgccgtgtactactgcgccaaggacctgggcggcagcaagaccgacgagtggggcaccgactactgctaccccgtgcaggaccccagagtggtggtgggcgccttcgacatctggggccacggcaccatggtgaccgtgagcagc

SEQ ID NO: 32603 - RNA, 432 nt, synthetic construct
  misc_feature 1..432: note = derived and/or modified sequence opt4 from anti-HIV_cap256-059-079417_VR-Chain
  source 1..432: mol_type = other RNA
caggtgcagctggtggagagcggcggcggcgtggtgcagcccggcagaagcctgagactgagctgcgccgccagcggcttcagcttcagcaactacgccatggactgggtgagacaggcccccggcaagggcctggagtgggtggccttcgtgagcagcgacggcaacaacaagaagtacgccgacagcgtgaagggcagattcaccctgagcagagacaactacaagaacaccgtgtacctgcagatgaacagcctgaccgtggaggacaccgccgtgtactactgcgccaaggacctgggcgccaacaaggacgacgagtggggcaccgactactacgacatgagcgtgagctaccccatccccgaccccagagccgtggtgggcgccttcgacgtgtggggccagggcaccctggtgaccgtgagcagc

SEQ ID NO: 32604 - RNA, 435 nt, synthetic construct
  misc_feature 1..435: note = derived and/or modified sequence opt4 from anti-HIV_cap256-059-076027_VR-Chain
  source 1..435: mol_type = other RNA
caggtgcagctggtggagagcggcggcggcgtggtgcagcccggcagaagcctgagactgagctgcgccgccagcggcttcagcttcagcaagtacggcatgcactgggtgagacaggcccccggcaagggcctggagtgggtggccttcgtggccttcgacgagagcgagaagtactacgccgccagcgtgaagggcagattcaccatcagcagagacaacagcaagaacaccctgagcctgcagatgaacagcctgagaaccgaggacaccgccatctactactgcgccaaggaggtgggcgacaacaaggacgacgagtggaccagcccctactactacgacatcagcatcgcctaccccgtgcacgaccccagagccgtggtgggcgtgagcgacgtgtggggccagggcaccatggtgaccgtgagcagc

SEQ ID NO: 32605 - RNA, 432 nt, synthetic construct
  misc_feature 1..432: note = derived and/or modified sequence opt4 from anti-HIV_cap256-059-075082_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgtgggcatcaagaagtactacgccgacagcgtgaagggcagattcaccatcagcagagacaacagcaagaacaccctgtacctgcagatgaacagcctgagagccgaggacaccgccctgtactactgcgccaaggacctgagagagatggagtgcgaggagtgggccagcgactactacgacttcggcagagacctgccctgccaggaccccagaggcgtggtgggcaccctggacatctggggccagggcaccatggtgaccgtgagcagc

SEQ ID NO: 32606 - RNA, 432 nt, synthetic construct
  misc_feature 1..432: note = derived and/or modified sequence opt4 from anti-HIV_cap256-059-072575_VR-Chain
  source 1..432: mol_type = other RNA
cagggccagctggtggagagcggcggcggcgtggtgcagcccggcagaagcctgagactgagctgcgccgccagccagttcaccttcagcaacttcggcatgcactgggtgagacaggcccccggcaagggcctggagtgggtggccgtgatcagctacgacggcaccaagaagtactacgccgacagcgtgaagggcagattcaccatcagcagagacaacagcaagaacaccctgtacctgcagatgaacagcctgagagccgaggacaccgccctgtactactgcgccaaggacatgagagaggacgagtgcgaggagtggggcgccgactactacgacttcggcaaggactacccctgccaggccagcagaggcgtggtgggcatcttcgacatctggggccagggcaccatggtgaccgtgagcgcc

SEQ ID NO: 32607 - RNA, 432 nt, synthetic construct
  misc_feature 1..432: note = derived and/or modified sequence opt4 from anti-HIV_cap256-059-071926_VR-Chain
  source 1..432: mol_type = other RNA
caggtgcagctggtggagagcggcggcggcgtggtgcagcccggcagaagcctgagactgagctgcgccgccagccagctgagcttcagcaactacggcatgcactgggtgagacaggcccccggcaagggcctggagtgggtggccggcatcagcttcgtgggcatcaagaagtactacagagacagcgtgaagggcagattcaccatcagcagagacaacagcaagaacaccctgtacctgcagatgaacagcctgagaaccgaggacaccgccctgtactactgcgtgaaggacctgagagagttcgagtgcgaggagtgggccagcgactactacgacttcggcagagaccagccctgcctggaccccagaggcgtggtgggcaccttcgacatctggggccagggcaccatggtgaccgtgagcagc

SEQ ID NO: 32608 - RNA, 432 nt, synthetic construct
  misc_feature 1..432: note = derived and/or modified sequence opt4 from anti-HIV_cap256-059-069638_VR-Chain
  source 1..432: mol_type = other RNA
caggtgcagctggtggagagcggcggcggcgtggtgcagcccggcagaagcctgagactgagctgcgccgccagcggcttcaccttcagcaagaacgccatgcactgggtgagacaggcccccggcagaggcctggagtgggtggccagcgtggccttcgacggcagcgacaagtactacgccgacagcgtgaagggcagattcaccatcagcagagacaacagcaagaacaccctgagcctgcagatgaacagcctgagagccgaggacaccgccgtgtactactgcgccaaggaggtggacctgtacaaggacgacgagtggggcagcgactactacgacctgagcatcgcctaccccatccaggaccccagagccgtggtgggcggcttcggcatctggggccagggcaccatggtgaccgtgagcagc

SEQ ID NO: 32609 - RNA, 432 nt, synthetic construct
  misc_feature 1..432: note = derived and/or modified sequence opt4 from anti-HIV_cap256-059-069165_VR-Chain
  source 1..432: mol_type = other RNA
ctggtgcagctggtggagagcggcggcggcgtggtgcagcccggcagaagcctgagactgagctgcgccgccagcagattcaccttcagcaactacggcatgcactgggtgagacaggcccccggcaagggcctggagtgggtggccggcatcagcttcgccggcaccaccaagtactacgccgacagcgtgagaggcagattcaccatcagcagagacaacagcaagaacaccctgtacctgcagatgaacagcctgagagccgaggacaccgccctgtactactgcgccaaggacatgagagagatggagtgcgaggagtgggccagcgactactacgacttcggcagaccccagccctgccaggaccccagaggcgtggtgggcatcttcgacatctggggccagggcaccatggtgaccgtgagcagc

SEQ ID NO: 32610 - RNA, 432 nt, synthetic construct
  misc_feature 1..432: note = derived and/or modified sequence opt4 from anti-HIV_cap256-059-068956_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcagaggcctggagtgggtggccctgatcagctacgacggcagcaacaagtactacgtggacagcgtgaagggcagattcaccatcagcagagacaacagcaagaacaccctgtacctgcagatgaacagcctgaccgccgaggacaccgccgtgtactactgcgccaaggacctgggcggcagcaaggacgacgagtgggccaccgactactacgacctgagcatcgcctaccccatccaggaccccagagccgtggccggcatcttcgacgtgtggggcagaggcaccgtggtgaccgtgagcagc

SEQ ID NO: 32611 - RNA, 432 nt, synthetic construct
  misc_feature 1..432: note = derived and/or modified sequence opt4 from anti-HIV_cap256-059-068876_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgccggcaccaagaagtactacgccaacagcgtgaagggcagattcaccatcagcagagacaacagcaagaacaccctgagcctgcagatgaacagcctgagaggcgaggacaccgccagatactactgcgccagagaccccagagagtacgagtgcgaggagtgggccagcgactactacgacttcggcagagaccagccctgccaggaccccagaggcgtgatcggcatcttcgacatctggggccagggcaccatggtgaccgtgagcagc

SEQ ID NO: 32612 - RNA, 432 nt, synthetic construct
  misc_feature 1..432: note = derived and/or modified sequence opt4 from anti-HIV_cap256-059-067733_VR-Chain
  source 1..432: mol_type = other RNA
caggtgcagctggtggagagcggcggcggcgtggtgcagcccggcagaagcctgagactgagctgcaccgccagccagttcagcttcagcagctacggcatgcactgggtgagacaggcccccggcaagggcctggagtgggtggccgccatcagcttcgccggcaccaagaagaactacgtggacagcgtgaagggcagattcaccatcagcagagacaacagcaagaacaccctgtacctgcagatgaacagcctgagagccgacgacaccgccctgtactactgcgccaaggacatgagagagtacgagtgcgaggagtgggccagcgactactacgacttcggcagagagtacccctgcaccgaccccagaggcgtggtgggcaccttcgacgtgtggggccagggcaccatggtgaccgtgagcagc

SEQ ID NO: 32613 - RNA, 432 nt, synthetic construct
  misc_feature 1..432: note = derived and/or modified sequence opt4 from anti-HIV_cap256-059-067450_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccggcatcagcttcgccggcatcaagaagtactacgccgacagcgtgaagggcagattcaccatcagcagagacaacgccaagaacaccctgtacctgcagatgaacagcctgagagccgaggacaccgccctgtactactgcgccaaggacctgagagagtacgagtgcgaggagtgggccagcgactactacgacttcggcagagagctgccctgccaggaccccagaggcgtggtgggcaccttcgacatctggggccagggcaccatggtgaccgtgagcagc

SEQ ID NO: 32614 - RNA, 432 nt, synthetic construct
  misc_feature 1..432: note = derived and/or modified sequence opt4 from anti-HIV_cap256-059-065694_VR-Chain
  source 1..432: mol_type = other RNA
caggtgcagctggtggagagcggcggcggcgtggtgcagcccggcagaagcctgagactgagctgcgccgccagccagctgaccttcaacaactacggcatgcactgggtgagacagacccccggcaagggcctggagtgggtggccggcatcagcttcgccggcatcaacaagtactacgccgacagcgtgaagggcagattcaccatcagcagagacaacagcaagaacgccctgtacctgcagatgaccagcctgagagccgaggacaccgccctgtactactgcgtgaaggacctgagagagatggagtgcgaggagtgggccagcgactactacgacttcggcagagaccagccctgccaggaccccagaggcgtggtgggcaccttcgacatctggggccagggcaccatggtgaccgtgagcagc

SEQ ID NO: 32615 - RNA, 432 nt, synthetic construct
  misc_feature 1..432: note = derived and/or modified sequence opt4 from anti-HIV_cap256-059-065109_VR-Chain
  source 1..432: mol_type = other RNA
caggtgcagctggtggagagcggcggcggcgtggtgcagcccggcaagagcctgagactgagctgcgccgccagcggcttcaccttcaccaacaacgccatgaactgggtgagacaggcccccggcaagggcctggagtgggtggccttcgtgagcagcgacggcagaaacaagaactacgccgacagcgtgaagggcagattcaccatcagcagagacaacagcaagaacaccgtgtacctgcagatgaacagcctgagagtggaggacaccgccctgtactactgcgccaaggacctgggcgccaacaaggacgacgagtgggccaccgactactacgacctgagcgtggcctaccccatccccgaccccagagccgtggtgggcgccttcgacgtgtggggccagggcaccatggtgaccgtgagcagc

SEQ ID NO: 32616 - RNA, 432 nt, synthetic construct
  misc_feature 1..432: note = derived and/or modified sequence opt4 from anti-HIV_cap256-059-065060_VR-Chain
  source 1..432: mol_type = other RNA
caggtgcagctggtggagagcggcggcggcgtggtgcagcccggcaccagcctgagactgagctgcgccgccagcggcttcaccttcagcaactacgccatgggctgggtgagacaggcccccggcaagggcctggagtgggtggccgtggtgagctacgacggcagcaagaagagctacgccgacagcgtgaagggcagattcaccatcagcagagacaacagcagaaacaccctgtacctgcagctgaacagcctgagagccgaggacaccgccatgttctactgcgccaaggacctgggcaagggcgagatcgaggagtgggccaccgactactacgactggagcaaggcctaccccatcgagggccccagagacgtggtgggcgccttcgacacctggggccagggcaccctggtgaccgtgagcagc

SEQ ID NO: 32617 - RNA, 432 nt, synthetic construct
  misc_feature 1..432: note = derived and/or modified sequence opt4 from anti-HIV_cap256-059-064001_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccggcatcagcttcgccggcaccaagaactactacgccaagagcgtgaagggcagattcaccatcagcagagacaacagcaagaacgccctgtacctgcagatgaacagcctgagagccgaggacaccgccctgtactactgcgccaaggacatgagagagtacgagtgcgaggagtgggccagcgactactacgacttcggcagagaccagccctgccaggaccccagaggcgtggtgggcaccttcgacatctggggccagggcaccatggtggccgtgagcagc

SEQ ID NO: 32618 - RNA, 432 nt, synthetic construct
  misc_feature 1..432: note = derived and/or modified sequence opt4 from anti-HIV_cap256-059-063270_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccgccatcagcttcgccggcaccaagaagcactacgccgacagcgtgaagggcagattcaccatcagcagagacaacagcaagaacgccctgtacctgcagatgaacagcctgagagccgaggacaccgccctgtactactgcgccaaggacctgagagagtacgagtgcgaggagtgggccagcgactactacgacttcggcagagaccagccctgcctggaccccagaggcgtggtgggcatcttcgacatctggggccagggcaccctggtgaccgtgagcagc

SEQ ID NO: 32619 - RNA, 432 nt, synthetic construct
  misc_feature 1..432: note = derived and/or modified sequence opt4 from anti-HIV_cap256-059-061357_VR-Chain
  source 1..432: mol_type = other RNA
caggtgcagctggtggagagcggcggcggcgtggtgcagcccggcagaagcctgagactgagctgcgccgccagcggcttcaccttcagcaacttcggcttccactgggtgagacaggcccccggcaagggcctggagtgggtggccggcatcagcttcgccggcaccaagatctactacgccgacagcgtgaagggcagattcaccatcagcagagagaacagcaagaacatgctgtacctgcagatgaacagcctgagaggcgaggacaccgccgtgtacttctgcgccaaggacctgagagagttcgagtgcgaggagtgggccagcgactactacgacttcggcagagagttcccctgccaggaccccagaggcgtggtgggcaccttcgacgtgtggggccacggcgccgtggtgaccgtgagcagc

SEQ ID NO: 32620 - RNA, 435 nt, synthetic construct
  misc_feature 1..435: note = derived and/or modified sequence opt4 from anti-HIV_cap256-059-059834_VR-Chain
  source 1..435: mol_type = other RNA
caggtgcagctggtggagagcggcggcggcgtggtgcagcccggcagaagcctgagactgagctgcgccgccagcggcttcaccttcagcaacttcggcatgcactgggtgagacaggcccccggcaagggcctggagtgggtggccttcgtggccttcgacgagagcgacaagtactacgccgccagcgtgaagggcagattcaccgtgagcagagacaacagcaagaacaccgtgagcctgcagatgaacagcctgagaaccgaggacaccgccgtgtactactgcgccaaggaggtgggcgacaacaaggacgacgagtggaccagcccctactactacgacttcagcatcgcctaccccgtgcacgaccccagagccgtggtgggcggctacgacgtgtggggccagggcaccatggtgaccgtgagcagc

SEQ ID NO: 32621 - RNA, 432 nt, synthetic construct
  misc_feature 1..432: note = derived and/or modified sequence opt4 from anti-HIV_cap256-059-059313_VR-Chain
  source 1..432: mol_type = other RNA
caggtgcacctggtggagagcggcggcggcgtggtgcagcccggcaagagcctgagactgagctgcgccgccagccagttcaccttcagcaacttcggcatgcactgggtgagacaggcccccggcaagggcctggagtgggtggccggcatcagcttcgccggcaccaagaagtactacgccgacagcgtgaagggcagattcaccatcagcagagacaacagcaagaacaccctgtacctgcagatgaacagcgtgagagccgaggacaccgccctgtactactgcgccaaggacatgagagagtacgagtgcgaggagtgggccagcgactactacgacttcggcaagccccagccctgccaggaccccagaggcgtggtgggcaccttcgacatgtggggcctgggcaccctggtgaccgtgagcagc

SEQ ID NO: 32622 - RNA, 432 nt, synthetic construct
  misc_feature 1..432: note = derived and/or modified sequence opt4 from anti-HIV_cap256-059-057130_VR-Chain
  source 1..432: mol_type = other RNA
caggtgcagctggtggagagcggcggcggcgtggtgcagcccggcagaagcctgagactgagctgcgccgccagccagttcagcttcagcagctacggcatgcactgggtgagacaggcccccggcaagggcctggagtgggtggccgccatcagcttcgccggcatcaagaagcactacgccgacagcgtgaagggcagattcaccatcagcagagacaacagcaagaacaccctgtacctgcagatgaacagcctgagagtggaggacaccgccctgtactactgcgccaaggacctgagagagtacgagtgcgaggagtgggccagcgactactacgacttcggcagaccccagccctgccaggaccccagaggcgtggtgggcaccagcgacatctggggccagggcaccatggtgaccgtgagcagc

SEQ ID NO: 32623 - RNA, 411 nt, synthetic construct
  misc_feature 1..411: note = derived and/or modified sequence opt4 from anti-HIV_cap256-059-050520_VR-Chain
  source 1..411: mol_type = other RNA
caggtgcagctggtggagagcggcggcggcgtggtgcagcccggcagaagcctgagactgagctgcgccgccagccagttcaccttcaacagatacggcatgcactgggtgagacaggcccccggcaagggcctggagtgggtggccgtgatcagctacgccgacagcgtgaagggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcagagagctgccctgcagaaagagcagaggcgtggccggcatcttcgacatctggggccagggcaccatggtgaccgtgagcagc

SEQ ID NO: 32624 - RNA, 432 nt, synthetic construct
  misc_feature 1..432: note = derived and/or modified sequence opt4 from anti-HIV_cap256-059-049839_VR-Chain
  source 1..432: mol_type = other RNA
caggtgcagctggtggagagcggcggcggcgtggtgcagcccggcagaagcctgagactgagctgcgccgccagcggcttcagcttcagcaactacgccatggactgggtgagacaggcccccggcaagggcctggagtgggtggccgtggtgagcagcgacggcaagaccaagaactacgccgacagcgtgaagggcagattcaccatcagcagagacaacagcaagaacaccgtgtacctgcagatgaacagcctgagacccgaggacaccgccgtgtactactgcgccaaggacctgggcgccaacaaggacgacgagtggaccaccgactactacgactggagcgtggcctaccccgtgcccgaccccagagccgtggtgggcgccttcgacgtgtggggccagggcaccatggtgaccgtgagcagc

SEQ ID NO: 32625 - RNA, 432 nt, synthetic construct
  misc_feature 1..432: note = derived and/or modified sequence opt4 from anti-HIV_cap256-059-048503_VR-Chain
  source 1..432: mol_type = other RNA
caggtgcagctggtggagagcggcggcggcgtggtgcagcccggcagaagcctgagactgagctgcgccgccagccagctgagcttcagcaactacggcatgcactgggtgagacaggcccccggcaagggcctggagtgggtggccggcaccagcttcgccggcaccaagaagtactacgccgacagcgtgaagggcagattcaccatcagcagagacaacagcaagaacgccctgtacctgcagatgaacagcctgagagccgaggacaccgccctgtactactgcgccaaggacctgagagagtacgagtgcgaggagtgggccagcgactactacgacttcggcagagaccagccctgccaggaccccagaggcgtggtgggcaccttcgacatctggggccagggcaccatggtgaccgtgagcgcc

SEQ ID NO: 32626 - RNA, 432 nt, synthetic construct
  misc_feature 1..432: note = derived and/or modified sequence opt4 from anti-HIV_cap256-059-045516_VR-Chain
  source 1..432: mol_type = other RNA
caggtgcagctggtggagagcggcggcggcgtggtgcagcccggcagaagcctgagactgagctgcgccgccagccagttcaccttcagcggctacggcatgcactgggtgagacaggcccccggcaagggcctggagtgggtggccgccatcagcttcgccggcaacaagagatacttcgccgacagcgtgaagggcagattcaccatcagcagagacaacagcaagaacaccctgttcctgcagatgaacagcctgagagccgaggacaccgccctgtactactgcgccagagacatgagagagtacgagtgcgaggagtgggccagcgactactacgacttcggcagaccccagccctgccaggaccccagaggcgtggtgggcgtgttcgacatctggggccagggcaccatggtgaccgtgagcagc

SEQ ID NO: 32627 - RNA, 432 nt, synthetic construct
  misc_feature 1..432: note = derived and/or modified sequence opt4 from anti-HIV_cap256-059-044188_VR-Chain
  source 1..432: mol_type = other RNA
caggtgcacctggtggagagcggcggcggcgtggtgcagcccggcagaagcctgagactgagctgcgccgccagccagttcaccttcagcagctacggcatgcactgggtgagacaggcccccggcaagggcctggagtgggtggccggcatcagcttcgccggcaccaacaagtactacgccgacagcgtgaagggcagattcaccgtgagcagagacaacagcaagaacaccctgtacgtgcagatgaacagcctgagagccgaggacaccgccctgtactactgcgccagagacctgagagagtacgagtgcgaggagtgggccagcgactactacgacttcggcagagagcagccctgccaggaccccagaggcgtggtgggcatcttcgacatctggggccccggcaccatggtgaccgtgagcagc

SEQ ID NO: 32628 - RNA, 435 nt, synthetic construct
  misc_feature 1..435: note = derived and/or modified sequence opt4 from anti-HIV_cap256-059-044105_VR-Chain
  source 1..435: mol_type = other RNA
cagggccagctggtggagagcggcggcggcgtggtgcagcccggcagaagcctgagcctgagctgcgccgccagcggcttcagcttcaacaactacgccatggactgggtgagacaggcccccggcaagggcctggagtgggtggccgtggtgagcagcgacggcaacaacaagaactacgccgacagcgtgaagggcagattcaccatcagcagagacaacagcaagaacaccgtgtacctgcagatgaacagcctgagagccgaggacaccgccatctactactgcgccaaggacgtgggcgccaacaaggacgacgagtgggccaccaactactactacgactggagcgtggcctaccccgtgcccgaccccagagccgtgatcggcgccttcgacgtgtggggccagggcaccatggtgaccgtgagcagc

SEQ ID NO: 32629 - RNA, 432 nt, synthetic construct
  misc_feature 1..432: note = derived and/or modified sequence opt4 from anti-HIV_cap256-059-042100_VR-Chain
  source 1..432: mol_type = other RNA
caggtgcagctggtggagagcggcggcggcgtggtgcagcccggcagaagccagagactgagctgcgccgccagccagttcaccttcagcagctacggcatgcactgggtgagacaggcccccggcaagggcctggagtgggtggccgccatcagcttcgccggcaccaacaagtactacggcgacagcgtgaagggcagattcaccatcagcagagacaacagcaagaacaccctgtacctgcagatgaacagcctgagagccgaggacaccgccctgtaccactgcgccagagacatgagagagtacgagtgcgaggagtgggccagcgactactacgacttcggcagagaccagccctgccaggaccccagaggcgtggtgggcatcttcgacctgtggggccagggcaccatggtgaccgtgagcagc

SEQ ID NO: 32630 - RNA, 432 nt, synthetic construct
  misc_feature 1..432: note = derived and/or modified sequence opt4 from anti-HIV_cap256-059-040742_VR-Chain
  source 1..432: mol_type = other RNA
caggtgcagctggtggagaccggcggcggcgtgggccagcccggcaagagcctgagactgagctgcgccgccagcggcttcaccttcagcaacttcgccatggactgggtgagacaggcccccggcaagggcctggagtgggtggccttcatcagcagcgacggcatcaacaagaagtacggcgacttcgtgaagggcagattcaccatcagcagagacaacagcaagaacaccctgttcctgcagatgaacagcctgagagccgaggacaccgccctgtactactgcgccaaggacgtgggcgactacaagagcgacgagtggggcaccgactactacgacctgagcatcgagtaccccatccaggaccccagagccgtggtgggcgccttcgacaactggggccagggcaccatggtgatcgtgagcagc

SEQ ID NO: 32631 - RNA, 432 nt, synthetic construct
  misc_feature 1..432: note = derived and/or modified sequence opt4 from anti-HIV_cap256-059-040554_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccggcatcagcttcgccgccaccaacaagtactacggcggcagcgtgaagggcagattcaccatcagcagagacaacagcaagaacaccctgtacctgcagatgaacagcctgagagccgaggacaccgccctgtactactgcaccagagacatgagagagtacgagtgcgaggagtgggccagcgactactacgacttcggcaaggaccagccctgccaggaccccagaggcgtggtgggcaccctggacatctggggccagggcaccatggtgaccgtgagcagc

SEQ ID NO: 32632 - RNA, 432 nt, synthetic construct
  misc_feature 1..432: note = derived and/or modified sequence opt4 from anti-HIV_cap256-059-039660_VR-Chain
  source 1..432: mol_type = other RNA
caggtgcagctggtggagagcggcggcggcgtggtgcagcccggcagaagcctgagactgagctgcgccgccagccagttcagcttcagcaactacggcatgcactgggtgagacaggcccccggcaagggcctggagtgggtggccagcatcagcttcgccggcaccaagaagaagtacgccgacagcgtgaagggcagattcaccatcagcagagacaacagcaagaacaccctgttcctgcagatgaacagcctgagaaccgaggacgccgccctgtactactgcgccaaggacatgagagagttcgagtgcgaggagtgggccagcgactactacgacttcggcagagagcagccctgccaggacaccagagacgtggtgggcatcttcgacatctggggccagggcaccatggtgaccgtgagcagc

SEQ ID NO: 32633 - RNA, 435 nt, synthetic construct
  misc_feature 1..435: note = derived and/or modified sequence opt4 from anti-HIV_cap256-059-039298_VR-Chain
  source 1..435: mol_type = other RNA
caggtgcagctggtggagagcggcggcggcgtggtgcagcccggcagaagcctgagactgagctgcgccgccagcggcttcaccttcagcaagtacggcatgcactgggtgagacaggcccccggcaagggcctggagtgggtggccttcgtggccttcgacgagagcgacaagtactacgccgccagcgccaagggcagattcatcatcagcagagacaacagcaagaacaccctgagcctgcagatgaacagcctgagaaccgaggacaccgccgtgtactactgcgccaaggaggtgggcgacaacaaggacgacgagtggaccagcccctactactacgacatcagcatcgcctaccccgtgcaggaccccagagccgtggtgggcggctacgacgtgtggggccagggcaccatggtgaccgtgagcagc

SEQ ID NO: 32634 - RNA, 432 nt, synthetic construct
  misc_feature 1..432: note = derived and/or modified sequence opt4 from anti-HIV_cap256-059-037873_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccgccatcagcttcgccggcatcaacaagtactacgccgacagcgtgaagggcagattcaccctgagcagagacaacaccaagaacaccctgtacctgcagatgaacagcctgagagccgaggacaccgccctgtactactgcgccagagacctgagagagtacgagtgcgaggagtgggccagcgactactacgacttcggcagaccccagccctgccaggaccccagaggcgtggtgggcaccagcgacatctggggccagggcaccatggtgaccgtgagcagc

SEQ ID NO: 32635 - RNA, 432 nt, synthetic construct
  misc_feature 1..432: note = derived and/or modified sequence opt4 from anti-HIV_cap256-059-037633_VR-Chain
  source 1..432: mol_type = other RNA
caggtgcagctggtggagagcggcggcggcgtggtgcagcccggcagaagcctgagactgagctgcgccgccagccagttcaccttcagcaacttcggcatgcactgggtgagacaggcccccggcaagggcctggagtgggtggccgccatcagcttcgccggcatcaacaagaactacgccgacagcgtgaagggcagattcaccatcagcagagacaacagcaagaacaccctgcacctgcagctgaacagcctgagagccgaggacaccgccctgtactactgcgccaaggacctgagagagtacgagtgcgaggagtgggccagcgactactacgacttcggcagagaccagccctgccaggaccccagaggcgtggtgggcaccttcgacatctggggccagggcaccatggtgaccgtgagcagc

SEQ ID NO: 32636 - RNA, 432 nt, synthetic construct
  misc_feature 1..432: note = derived and/or modified sequence opt4 from anti-HIV_cap256-059-036817_VR-Chain
  source 1..432: mol_type = other RNA
caggtgcagctgctggagagcggcggcggcgtggtgcagcccggcagaagcctgagactgagctgcgaggccagccagttcaccttcagcaacttcggcatgcactgggtgagacaggcccccggcaagggcctggagtgggtggccgccatcagcttcgccggcatcaagaagaactacgccgacagcgtgaagggcagattcaccatcagcagagacaacagcaagaacaccctgtacctgcagatgaacagcctgagagtggaggacaccgccctgtactactgcgccaaggacctgagagagtacgagtgcgaggagtgggccagcgactactacgacttcggcagagagcagccctgccaggaccccagaggcgtgatcggcaccttcgacatctggggccagggcaccatggtgaccgtgagcagc

SEQ ID NO: 32637 - RNA, 432 nt, synthetic construct
  misc_feature 1..432: note = derived and/or modified sequence opt4 from anti-HIV_cap256-059-032787_VR-Chain
  source 1..432: mol_type = other RNA
caggtgcagctggtggagagcggcggcggcgtggtgcagcccggcagaagcctgagactgagctgcgccgccagcggcttcaccttcagcaagtacgccatgcactgggtgagacaggcccccggcaagggcctggagtgggtggccttcgtggccttcgacgagagcgacaagtactacgtggacagcgtgaagggcagattcaccatcagcagagacaacagcaagaacaccctgagcctgcagatgaacagcctgagagccgaggacaccgccgtgtactactgcgccaaggaggtgcacgtgaacaaggacgacgagtgggccagcgactactacgacctgagcatcgcctaccccatccaggaccccagagccgtggtgggcggcctggacatctggggccagggcaccatggtgaccgtgagcagc

SEQ ID NO: 32638 - RNA, 432 nt, synthetic construct
  misc_feature 1..432: note = derived and/or modified sequence opt4 from anti-HIV_cap256-059-032427_VR-Chain
  source 1..432: mol_type = other RNA
caggtgcagctggtggagagcggcggcggcgtggtgcagcccggcagaagcctgagactgagctgcgccgccagccagttcaccttcagcaacttcggcatgcactgggtgagacaggcccccggcaagggcctggagtgggtggccggcatcagcttccccggcaccaagaagtactacgccgacagcgtgaagggcagattcaccatcagcagagacaacagcaagaacgccctgtacctgcagatgaacagcctgagagccgaggacaccgccctgtactactgcgccagagacctgagagagtacgagtgcgaggagtgggccagcgactactacgacttcggcaagccccagccctgcctggaccccagaggcgtggtgggcaccttcgacatctggggccagggcaccatggtgaccgtgagcagc

SEQ ID NO: 32639 - RNA, 435 nt, synthetic construct
  misc_feature 1..435: note = derived and/or modified sequence opt4 from anti-HIV_cap256-059-029390_VR-Chain
  source 1..435: mol_type = other RNA
caggtgcagctggtggagagcggcggcggcgtggtgcagcccggcagaagcctgagactgagctgcgccgccagcggcttcaccttcaaccagcacggcatgcactgggtgagacaggcccccgacaagggcctggagtgggtggccttcgtgggcttcgacgagagcgagaagtactacgccgacagcgtgaagggcagattcaccatcagcagagacaacagcaagaacaccctgagcctgcagatgaacagcctgagacccgaggacaccgccgtgtactactgcgccaaggaggtgggcgacaacaaggaggacgagtgggccagcgactactactacgacctgagcaacgcctaccccatccacgaccccagagccgtggtgggcggctacgacatctggggccagggcaccatggtgaccgtgtgcagc

SEQ ID NO: 32640 - RNA, 435 nt, synthetic construct
  misc_feature 1..435: note = derived and/or modified sequence opt4 from anti-HIV_cap256-059-027877_VR-Chain
  source 1..435: mol_type = other RNA
caggtgcagctggtggagagcggcggcggcgtggtgcagcccggcagaagcctgagactgagctgcagcgccagcgccttcagcttcagctacttcgccatggactgggtgagacaggcccccggcaagggcctggagtgggtggccttcgtgagcagcgacggcaacaacaagaactacgccgacagcgtgaagggcagattcaccatcagcagagacaacagcaagaacaccgtgttcctgcagatggacagcctgagacccgaggacaccgccgtgtactactgcgccaaggacctgggcggcaacaaggacgacgagtggagcaccaactactactacgacatcagcatcgccgaccccgtgcccgaccccagagccgtggccggcgccttcgacgtgtggggccagggcaccatggtgaccgtgagcagc

SEQ ID NO: 32641 - RNA, 435 nt, synthetic construct
  misc_feature 1..435: note = derived and/or modified sequence opt4 from anti-HIV_cap256-059-026640_VR-Chain
  source 1..435: mol_type = other RNA
caggtgcagctggtggagagcggcggcggcgtggtgcagcccggcagaagcctgagactgagctgcgccgccagcggcttcagcttcagcaagtacggcatgcactgggtgagacaggcccccggcaagggcctggagtgggtggccttcgtggccttcgacgagagcgacagatactacgccgccagcgtgaagggcagattcaccatcagcagagacaacagcaagaacaccctgagcctgcagatgaacagcctgagaaccgaggacaccgccatctactactgcgccaaggaggtgggcgacaacaaggacgacgagtggaccagcccctactactacgacatgagcatcgcctaccccgtgcaggaccccagagccgtggtgggcggctacgacatctggggccagggcaccatggtgaccgtgagcagc

SEQ ID NO: 32642 - RNA, 432 nt, synthetic construct
  misc_feature 1..432: note = derived and/or modified sequence opt4 from anti-HIV_cap256-059-026017_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccctgatcagctacgacggcaccaacaagtactacgtggacagcgccaagggcagattcaccatcagcagagacaacagcaagaacaccctgtacctgcagatgaacagcctgacccccgaggacaccgccgtgttctactgcgccaaggacctgggcggctacaaggacgacgagtggggcaccgagtactacgacatcagcgtgagctaccccgtgcaggaccccagagccgtggccggcgtgttcgacgtgtggggccacggcaccatggtgaccgtgagcagc

SEQ ID NO: 32643 - RNA, 432 nt, synthetic construct
  misc_feature 1..432: note = derived and/or modified sequence opt4 from anti-HIV_cap256-059-024100_VR-Chain
  source 1..432: mol_type = other RNA
tgccaggtgctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgccggcaccaagaagtactacgccgacagcgtgaagggcagattcgccatcagcagagacaccagcaagaacgccctgtacctgcagatgaacaccctgagagccgaggacaccgccctgtactactgcgccagagacctgagagagttcgagtgcgaggagtgggccagcgactactacgacttcggcagaccccagccctgccaggaccccagaggcgtggtgggcagcttcgacatctggggccagggcaccatggtgaccgtgagcctg

SEQ ID NO: 32644 - RNA, 432 nt, synthetic construct
  misc_feature 1..432: note = derived and/or modified sequence opt4 from anti-HIV_cap256-059-023966_VR-Chain
  source 1..432: mol_type = other RNA
caggtgcagctggtggagagcggcggcggcgtggtgcagcccggcagaagcctgagactgagctgcgccgccagccagttcagcttcagcagctacggcatgcactgggtgagacaggcccccggcaagggcctggagtgggtggccgccatcagcttcgccggcatcaagaagcactacaccgacagcgtgaagggcagattcaccatcagcagagacaacagcaagaacaccctgtacctgcagatgaacagcctgagagccgaggacaccgccctgtactactgcgccaaggacctgagaggcttcgagtgcgaggagtgggccagcgactactacgacttcggcagagaccagccctgccaggaccccagaggcgtggtgggcaccttcgacatctggggccagggcaccctggtgaccgtgagcagc

SEQ ID NO: 32645 - RNA, 432 nt, synthetic construct
  misc_feature 1..432: note = derived and/or modified sequence opt4 from anti-HIV_cap256-059-020534_VR-Chain
  source 1..432: mol_type = other RNA
caggtgcagctggtggagagcggcggcggcgtggtgcagcccggcagaagcctgagactgagctgcgccgccagccagttcaccttcagcaactacggcatgcactgggtgagacaggcccccggcaagggcctggagtgggtggccggcatgagcttcgccggcaccaacacctactacgccgacagcgtgaagggcagattcaccatcagcagagacaacagcaagaacaccctgtacctgcagatgaacagcctgagagccgtggacaccgccctgtactactgcgccagagacatgagagagtacgagtgcgaggagtgggccagcgactactacgacttcggcagagagtacccctgccaggaccccagaggcgtggtgggcatcttcgacctgtggggccagggcaccatggtgaccgtgagcagc

SEQ ID NO: 32646 - RNA, 435 nt, synthetic construct
  misc_feature 1..435: note = derived and/or modified sequence opt4 from anti-HIV_cap256-059-019513_VR-Chain
  source 1..435: mol_type = other RNA
caggtgcagctggtggagagcggcggcggcgtggtgcagcccggcagaagcctgagactgagctgcgccgccagcggcttcaccttcagcaacttcgccatgggctgggtgagacaggcccccggcaagggcctggagtgggtggccgtgatcagcagcgacggcaccaacaagaactacggcgacagcgtgaagggcagattcaccatcagcagagacaacagcaagaacaccctgttcctgcagatgaacagcctgagagccgaggacaccagcctgtactactgcgccaaggacctgggcggctacaagaccgacgagtgggccaccaactactactacgacatcagcatcgccagccccatccaggaccccagagccgtggtgggcgccttcgacatctggggccagggcaccatggtgaccgtgaccagc

SEQ ID NO: 32647 - RNA, 432 nt, synthetic construct
  misc_feature 1..432: note = derived and/or modified sequence opt4 from anti-HIV_cap256-059-012963_VR-Chain
  source 1..432: mol_type = other RNA
caggtgcagctggtggagagcggcggcggcgtggtgcagcccggcagaagcctgagactgagctgcgtggccagcggcttcagcttcagcagctacggcatggcctgggtgagacaggcccccggcaagggcctggagtgggtgaccgtgatcagcttcgccggcgtgaagacctactacgccgacagcgtgaagggcagattcaccatcagcagagacaacagcaagggcaccctgtacctgcagatggacggcctgagacccgaggacaccgccctgtactactgcgccaaggacctggccgagagagagtgcgaggagtgggccagcgactactacgacttcggcagagagctgccctgccaggaccccagaggcgtggtgggcaccttcgacgtgtggggccagggcaccatggtgaccgtgagcagc

SEQ ID NO: 32648 - RNA, 435 nt, synthetic construct
  misc_feature 1..435: note = derived and/or modified sequence opt4 from anti-HIV_cap256-059-010396_VR-Chain
  source 1..435: mol_type = other RNA
caggtgcagctggtggagagcggcggcggcgtggtgcagcccggcagaagcctgagactgagctgcgccgccagcggcttcagcttcaacaactacgccatgaactgggtgagacaggcccccggcaagggcctggagtgggtggccttcgtgagcagcgacggcagcaacaagaactacgccgacagcgtgaccggcagattcaccctgagcagagacaacagcaagaacaccgtgttcctgcagatgaacagcctgagagtggaggacaccgccgtgtactactgcgccaaggacgtgggcgccaacaaggacgacgagtggaccaccaactactactacgacatcagcatcgccgaccccgtgcccgaccccagagccgtgatcggcgccttcgacgtgtggggccagggcaccatggtgaccgtgagcagc

SEQ ID NO: 32649 - RNA, 432 nt, synthetic construct
  misc_feature 1..432: note = derived and/or modified sequence opt4 from anti-HIV_cap256-059-008136_VR-Chain
  source 1..432: mol_type = other RNA
caggtgcagctggtggagagcggcggcggcgtggtgcagcccggcagaagcctgagactgagctgcgccgccagcggcttcaccttcaacacctacgccatgcactgggtgagacaggcccccggcaagggcctggagtgggtggccctgatcagctacgacggcaccgagaagtactacgccgacagcgtgaagggcagattcaccatcagcagagacaacagcagaaacaccctgtacctgcagatgaacagcctgagactggaggacgccgccctgtaccagtgcgccaaggacctgggcggcagcaagagcgacgagtggggcaccgactactacgacatgagcatcagctaccccatccaggaccccagagccgtggccggcgtgttcgacatctggggccagggcaccctggtgaccgtgagcagc

SEQ ID NO: 32650 - RNA, 432 nt, synthetic construct
  misc_feature 1..432: note = derived and/or modified sequence opt4 from anti-HIV_cap256-059-006147_VR-Chain
  source 1..432: mol_type = other RNA
caggtgcaggtggtggagagcggcggcggcgtggtgcagcccggcagaagcctgagactgagctgcaccgccagcggcttcaccttcagcaacttcgccatgggctgggtgagacaggcccccggcaagggcctggagtgggtggccttcatcagcagcgacggcagcaacaagaactacggcgacagcgtgaagggcagattcaccatcagcagagacaacagcaagaacaccgtgttcctgcagatgaacagcctgagagtggaggacaccgccctgtactactgcgccaaggacgtgggcgactacaagagcgacgagtggggcaccgagtactacgacatcagcatcagctaccccatccaggaccccagagccatggtgggcgccttcgacctgtggggccagggcaccatggtgaccgtgagcccc

SEQ ID NO: 32651 - RNA, 432 nt, synthetic construct
  misc_feature 1..432: note = derived and/or modified sequence opt4 from anti-HIV_cap256-059-005081_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccggcatcagcttcgccgccaccaagaagtactacagcgagagcgtgaagggcagattcaccatcagcagagacaacagcaagaacgccctgcacctgcacatgaacagcctgagagccgaggacaccgccctgtactactgcgccaaggacctgagagagttcgagtgcgaggagtgggccagcgactactacgacttcggcagagaccagccctgccaggaccccagaggcgtggtgggcatcttcgacatgtggggccagggcaccatggtgaccgtgagcagc

SEQ ID NO: 32652 - RNA, 432 nt, synthetic construct
  misc_feature 1..432: note = derived and/or modified sequence opt4 from anti-HIV_cap256-059-005006_VR-Chain
  source 1..432: mol_type = other RNA
caggcccagctggtggagagcggcggcggcgtggtgcagcccgccaagagcctgagactgagctgcgccgccagcggcttcaccttcaacaagtacgccatgcactgggtgagacaggcccccggcaagggcctggagtgggtggccttcgtggccttcgacgagagcgacaagtactacgccgacagcgtgaagggcagattcaccatcagcagagacaacagcaagaacaccctgagcctgcagatgaacaacctgagagccgaggacaccgccgtgtactactgcgccaaggaggtgggcgacaacaaggacgacgagtgggccagcgactactacgacctgagcatcgcctaccccatccaggaccccagagccgtgggcagaggctacgacatctggggccagggcaccatggtgaccgtgagcagc

SEQ ID NO: 32653 - RNA, 432 nt, synthetic construct
  misc_feature 1..432: note = derived and/or modified sequence opt4 from anti-HIV_cap256-059-004451_VR-Chain
  source 1..432: mol_type = other RNA
caggtgcacctggtggagagcggcggcggcgtggtgcagcccggcaagagcctgagactgagctgcaccgccagcggcttcaccttcaccaacttcgccatggactgggtgagacaggcccccggcaagggcctggagtgggtggccttcatcagcagcgacggcagcaacaagtactacagcgagagcgtgaagggcagattcaccatcagcagagacaacagcaagaacaccctgtacgtgcagatgaacagcctgagaaccgaggacaccgccgtgtactactgcgccaaggacctgggcggctacaaggacgacgagtggagcaccgactactacgactggagcaccgcctaccccgtgcaggaccccagagccgtggccggcgccttcgacctgtggggccagggcaccatggtgagcgtgagcagc

SEQ ID NO: 32654 - RNA, 432 nt, synthetic construct
  misc_feature 1..432: note = derived and/or modified sequence opt4 from anti-HIV_cap256-059-003571_VR-Chain
  source 1..432: mol_type = other RNA
caggagcagctggtggagagcggcggcggcgtggtgcagcccggcagaagcctgagactgagctgcgccgccagccagttcaccttcggcgcctacggcatgcactgggtgagacaggcccccggcaagggcctggagtgggtggccggcgtgagcttcgtgggcaacaacaagtactacgccgacagcgtgaagggcagattcaccatcagcagagacaacagcaagaacaccctgtacctgcagatgaacagcctgagaggcgaggacaccgccctgtactactgcgccagagacatgagagagatggagtgcgaggagtgggccagcgactactacgacttcggcagaccccagccctgccaggaccccagaggcgtggtgggcatcttcgacatgtggggccagggcaccatggtgaccgtgagcagc

SEQ ID NO: 32655 - RNA, 432 nt, synthetic construct
  misc_feature 1..432: note = derived and/or modified sequence opt4 from anti-HIV_cap256-059-003449_VR-Chain
  source 1..432: mol_type = other RNA
caggtgcagctggtggagagcggcggcggcgtggtgcagcccggcaagagcctgagactgagctgcgccgccagccaggtgaccttcagcagctacggcatgcactgggtgagacaggcccccggcaagggcctggagtgggtggccggcatcagcttcgccggcaccaagaagtactacgccgacagcgtgaagggcagattcaccatcagcagagacaacagcaagaacgccctgtacctgcagatgaacagactgagagccggcgacaccgccctgtactactgcgccaaggacctgagagagtacgagtgcgaggagtgggccagcgactactacgacttcggcagagagcagccctgccaggaccccagaggcgtggtgggcatcttcgacatctggggcctgggcaccatggtgaccgtgagcagc

SEQ ID NO: 32656 - RNA, 432 nt, synthetic construct
  misc_feature 1..432: note = derived and/or modified sequence opt4 from anti-HIV_cap256-059-002712_VR-Chain
  source 1..432: mol_type = other RNA
caggtgcagctggccgagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgccggcaccaagaagcactacgccgacagcgtgaagggcagattcaccatcagcagagacaacagcaagaacaccctgaacctgcagatgaacagcctgagagccgaggacaccgccctgtactactgcgccagagacatgagagagtacgagtgcgaggtgtgggccagcgactactacgacttcggcagagagcagccctgccaggaccccagaggcgtggtgggcaccttcgacatctggggccagggcaccatggtgaccgtgagcccc

SEQ ID NO: 32657 - RNA, 432 nt, synthetic construct
  misc_feature 1..432: note = derived and/or modified sequence opt4 from anti-HIV_cap256-059-001573_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccggcatcagctacgacggcaccagcaagtactacgccgacagcgtgaagggcagattcaccatcagcagagacaacagcaagaacaccctgtacctgcagatgaacagcctgagagccgaggacaccgccctgtactactgcgccaaggacctgagagaggacgagtgcgaggagtggtggagcgactactacgacttcggcagagagctgccctgcagaaagagcagaggcgtggccggcaccttcgacatctggggccacggcaccatggtgaccgtgagcagc

SEQ ID NO: 32658 - RNA, 432 nt, synthetic construct
  misc_feature 1..432: note = derived and/or modified sequence opt4 from anti-HIV_cap256-059-001379_VR-Chain
  source 1..432: mol_type = other RNA
caggtgagactggtggagagcggcggcggcgtggtgcagcccggcagaagcctgagactgagctgcgccgccagcggcttcaccttcaacagctaccccatgcactgggtgagacaggcccccggcaagggcctggactgggtggccctgatcagctacgacggcaccaacaagttctacgtggacagcgtgaagggcagattcaccatcagcagagacaacagcaagaacaccctgtacctgcagatgaacagcctgaccgccgaggacaccgccatgtactactgcgccaaggacctgggcggcaacaaggacgacgagtggggcaccgactactacgacatcagcgtggcctaccccatccacgaccccagagccgtggccggcatcttcgacgtgtggggccacggcaccatggtgaccgtgagcagc

SEQ ID NO: 32659 - RNA, 432 nt, synthetic construct
  misc_feature 1..432: note = derived and/or modified sequence opt4 from anti-HIV_cap256-059-001029_VR-Chain
  source 1..432: mol_type = other RNA
caggagcagctggtgcagagcggcggcggcgtggtgcagcccggcagaagcctgagactgagctgcgcccccagccagttcaccttcagcgcccacggcatgcactgggtgagacaggcccccggcaagggcctggagtgggtggccggcatcagcttcgccggcaccaagaactactacgccgacagcgtgaagggcagattcaccatcagcagagacaacagcaagaacaccctgtacctgcagatgaacagcctgagagtggaggacaccgccctgtactactgcgccaaggacatgagagagatggagtgcgaggagtgggccagcgactactacgacttcggcagacaccagccctgccaggaccccagaggcgtggtgggcatcttcgacatctggggccagggcaccatggtgaccgtgagcagc

SEQ ID NO: 32660 - RNA, 432 nt, synthetic construct
  misc_feature 1..432: note = derived and/or modified sequence opt4 from anti-HIV_cap256-048-165087_VR-Chain
  source 1..432: mol_type = other RNA
gaggtgaagctgctggagagcggcggcggcctggtgcagcccggcggctacagaagactgagctgcgccgccagcggcttcaccttcagcagatacgccatgcactgggccagacaggcccccggcaagggcctggagtgggtggccgtggtgagcgacgacggcgtgaagaagtactaccccgacagcgtgagaggcagattcaccatcagcagagacaacagcagaaacaccgtgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32661 - RNA, 432 nt, synthetic construct
  misc_feature 1..432: note = derived and/or modified sequence opt4 from anti-HIV_cap256-048-158861_VR-Chain
  source 1..432: mol_type = other RNA
gaggtgcagctggtggagagcggcggcggcctggtgcagcccggcggcagcctgagactgagctgcgtggacttcggcttcagattcagcgagtactggatgagctgggtgagacaggcccccggcaagggcctggagtgggtggccgtgatcagctacgacggcaccaacaagtactacgccgacagcgtgaagggcagattcaccatcagcagagacaacagcaagaacaccctgtacctgcagatgaacagcctgagagccgaggacaccgccctgtactactgcgccaaggacatgagagagagcgagtgcgaggagtgggccagcgactactacgacttcggcaaggactacccctgccaggaccccagaggcgtggtgggcaccttcgacatctggggccagggcaccatggtgaccgtgagcagc

SEQ ID NO: 32662 - RNA, 435 nt, synthetic construct
  misc_feature 1..435: note = derived and/or modified sequence opt4 from anti-HIV_cap256-048-158280_VR-Chain
  source 1..435: mol_type = other RNA
caggtgcacctggtggagagcggcggcggcgtggtgcagcccggcagaagcctgagaatctactgcgccgtgagcgagttcaccttcagaaactacgccatgcactgggtgagactggcccccggcaagggcctgcagtgggtggccgtgatcagccacgacggcatcaacgactactacgccgacagcgtgaagggcagattcaccatcagcagagacaacagcaagaacaccgtgagcctgcagatgaacagcctgagacccgaggacaccgccgtgtactactgcgccaaggacctgggcgccaacaaggacgacgagtgggccaccgactactacgacctgagcatcgcctaccccgtgcccgaccccaccggcccctggttcggcgccttcgacatctggggccagggcaccatggtgaccgtgagcagc

SEQ ID NO: 32663 - RNA, 432 nt, synthetic construct
  misc_feature 1..432: note = derived and/or modified sequence opt4 from anti-HIV_cap256-048-157928_VR-Chain
  source 1..432: mol_type = other RNA
caggtgcagctgatggagagcggcggcggcgtggtgcagcccggcagaagcctgagactgagctgcgccatcagcggcttcaccttcagcaactactggatgagctgggtgagacaggcccccggcaagggcctggagtgggtggccgtgatcagcagcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32664 - RNA, 432 nt, synthetic construct
  misc_feature 1..432: note = derived and/or modified sequence opt4 from anti-HIV_cap256-048-157056_VR-Chain
  source 1..432: mol_type = other RNA
caggtgcagctggtggagagcggcggcggcgtggtgcagcccggcagaagcctgagactgagctgcgccgccagcggcttcaccctgagcagctacgccatgcactgggtgagacaggcccccggcaagggcctggagtgggtggccttcatcagcaacgacggcagcaacaagtacttcgccgacagcgtgaagggcagattcaccatcagcagagacaacagcaagaacaccctgtacctgcagatgaacagcctgagagccgaggacaccgccgtgtactactgcgccaaggacctgggcggcaacaaggacgacgagtgggccaccgactactacgacctgagcatcgcctaccccgtgcaggaccccagagtggtggtgggcatcttcgacatctggggccagggcaccatggtgaccgtgagcagc

SEQ ID NO: 32665 - RNA, 432 nt, synthetic construct
  misc_feature 1..432: note = derived and/or modified sequence opt4 from anti-HIV_cap256-048-156422_VR-Chain
  source 1..432: mol_type = other RNA
caggtgcagctggtggagagcggcggcaccgtggtgcagcccggcagaagcctgagactgagctgcgtgggcagcggcttcagcctgagctactacgccatccactgggtgagacaggcccccggcaagggcctggagtgggtggccgtgatcagctacgacggcagcaactactactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32666 - RNA, 432 nt, synthetic construct
  misc_feature 1..432: note = derived and/or modified sequence opt4 from anti-HIV_cap256-048-152863_VR-Chain
  source 1..432: mol_type = other RNA
gaggtgcagctgctggagagcggcggcggcctggtgcagcccggcggcagcctgagactgagctgcgccggcagcggcttcaccttcagcaagcacggcatgcactgggtgagacaggcccccggcaagggcctggagtgggtggccttcgtggccttcgacgagagcgacaagtactacgccgacagcgtgaagggcagattcaccatcagcagagacaacagcaagaacaccctgagcctgcagatgaacagcctgagagccgaggacaccgccatgtactactgcgccaaggaggtgggcgacaacaaggacgacgagtgggccagcgactactacgacctgagcatcgcctaccccgtgcacgaccccagagccgtggtgggcggctacgacatctggggccagggcaccatggtgaccgtgagcagc

SEQ ID NO: 32667 - RNA, 432 nt, synthetic construct
  misc_feature 1..432: note = derived and/or modified sequence opt4 from anti-HIV_cap256-048-152770_VR-Chain
  source 1..432: mol_type = other RNA
caggtgcagctggtggagagcggcggcggcgtggtgcagcccggcagaagcctgagactgagctgcgccgccagcggcttcaccttcagaagcaacgccatgcactgggtgagacaggcccccggcaagggcctggagtgggtggccgtgatcagctacgacggcagcaagacctactacgccgacagcgtgaagggcagattcaccatcagcagagacaacagcaagaacaccctgtacctgcagatgaacagcctgagagccgaggacaccgccgtgtactactgcgccaaggacctgggcgagtacaagagcgacgagtgggccaccgactactacgacctgagcatcgcctaccccgtgcaggaccccagaggcgtggccggcgccttcgacatctggggccagggcaccatggtgaccgtgagcagc

SEQ ID NO: 32668 - RNA, 432 nt, synthetic construct
  misc_feature 1..432: note = derived and/or modified sequence opt4 from anti-HIV_cap256-048-150027_VR-Chain
  source 1..432: mol_type = other RNA
gaggtgcagctggtggagagcggcggcggcctggtgcagcccggcggcagcctgagactgagctgcgccgtgagcggcttcaccttcagcagctacatcatgcactgggtgagacaggcccccggcaagggcctggagtgggtggccgtgatcagctacgacggcagcaacaaggactacgccgacagcgtgaagggcagattcaccatcagcagagacaacagcaagaacaccctgtacctgcagatgaacagcctgagagccgaggacaccgccctgtactactgcgccaaggacctgagagagtacgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32669 - RNA, 432 nt, synthetic construct
  misc_feature 1..432: note = derived and/or modified sequence opt4 from anti-HIV_cap256-048-148246_VR-Chain
  source 1..432: mol_type = other RNA
caggtgcagctggtggagagcggcggcggcgtggtgcagcccggcagaagcctgagactgagctgcgccaccagcggcttcaccttcagcacctacagcatgcactgggtgagacaggcccccggcaagggcctggagtgggtggccgtgatcagctacgacggcagcaacgagtactacgtggacagcgtgaagggcagattcaccatcagcagagacaacagcaagaacaccctgtacctgcagatgaacagcctgagagtggaggacaccgccctgtactactgcgccaaggacctgggcggcaacaaggacgacgagtggggcaccgactactacgacttcagcgtggcctaccccgtgcaggaccccagagccgtgagcggcatcttcgacgtgtggggccacggcaccatggtgaccgtgagcagc

SEQ ID NO: 32670 - RNA, 432 nt, synthetic construct
  misc_feature 1..432: note = derived and/or modified sequence opt4 from anti-HIV_cap256-048-147428_VR-Chain
  source 1..432: mol_type = other RNA
caggtgcagctggtggagagcggcggcggcgtggtgcagcccggcagaagcctgagactgagctgcagcgccagcggcttcaccttcagcaactacggcatgcactgggtgagacaggcccccggcaagggcctggagtgggtggccgtgatcagcttcgacggcagcaacaaggtgtacgccgacagcgtgaagggcagattcaccatcagcagagacaacagcaagaacaccctgtacctggagatgaacagcctgagagccgaggacaccgccgagtactactgcgccaaggacctgggcgagagcgacaaggaggagtggcccagcgactactacgacttcggcagagacttcaccggccaggtgcccagagccgtggtgggcatcttcgacatgtggggccagggcaccatggtgaccgtgagcagc

SEQ ID NO: 32671 - RNA, 432 nt, synthetic construct
  misc_feature 1..432: note = derived and/or modified sequence opt4 from anti-HIV_cap256-048-146603_VR-Chain
  source 1..432: mol_type = other RNA
gaggtgcagctggtggagagcggcggcggcctggtgcagcccggcagaagcctgagactgagctgcgccgccagcggcttcaccttcgacgactacgccatccactgggtgagacaggcccccggcaagggcctggagtgggtggccctgatcagctacgacggcaccgacaagtactacgccgacagcgtgaagggcagattcaccatcagcagagacaacagcaagaacaccctgtacctgcagatgaacagcctgagagtggaggacaccgccgtgtaccactgcgccaaggacctgggcggcaccaagagcgacgagtgggccaccgactactacgacctgagcatcgcctaccccatccaggaccccggcgccgtggtgggcgtgttcgacatctggggccagggcaccatggtgaccgtgagcagc

SEQ ID NO: 32672 - RNA, 432 nt, synthetic construct
  misc_feature 1..432: note = derived and/or modified sequence opt4 from anti-HIV_cap256-048-145735_VR-Chain
  source 1..432: mol_type = other RNA
caggtgcagctggtgcagagcggcggcggcgtggtgcagcccggcagaagcctgagactgagctgcggcgccagcggcttcaccttcagcaactacgccatgcactgggtgagacaggcccccggcaagggcctggactgggtggccgtgatcagctacgacggcaccaacgagaaccacgccgacagcgtgaagggcagattcaccatcagcagagacaacagcaagaacaccgtgtacctgcagatgaacagcctgagagccgaggacaccgccgtgtactactgcgccaaggacgtgggcggcagcaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32673 - RNA, 432 nt, synthetic construct
  misc_feature 1..432: note = derived and/or modified sequence opt4 from anti-HIV_cap256-048-145116_VR-Chain
  source 1..432: mol_type = other RNA
caggtgcacctggtggagagcggcggcggcgtggtgcagcccggcggcagcctgagactgagctgcgccgccagcggcttcaccttcagcaactacggcatgcactgggtgagacaggcccccggcaagggcctggagtgggtggccgccatcagcttcgccggcaccaacaagtactacgccgacagcgtgaagggcagattcaccatcagcagagacaacagcaagaacgccctgtacctgcagatgaacagcctgagagccgaggacaccgccctgtactactgcgccaaggacctgagagagagcgagtgcgaggagtgggccagcgactactacgacttcggcagagactacccctgccaggaccccagaggcgtggtgggcaccctggacatctggggccagggcaccatggtgaccgtgagcagc

SEQ ID NO: 32674 - RNA, 432 nt, synthetic construct
  misc_feature 1..432: note = derived and/or modified sequence opt4 from anti-HIV_cap256-048-144077_VR-Chain
  source 1..432: mol_type = other RNA
caggtgaagctggtggagagcggcggcggcgtggtgcagcccggcagaagcctgagactgagctgcgccgccagcggcttcaccctgagcagctacgccatgcactgggtgagacaggcccccggcaagggcctggagtgggtggccgtgatcagctacgacggcagcaacagatacaccgccgacagcgtgaagggcagattcaccatcagcagagacaacagcaagaacaccctgaacctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccaccgtgaccgtgagcagc

SEQ ID NO: 32675 - RNA, 432 nt, synthetic construct
  misc_feature 1..432: note = derived and/or modified sequence opt4 from anti-HIV_cap256-048-142876_VR-Chain
  source 1..432: mol_type = other RNA
caggtgcagctggtggagagcggcggcggcgtggtgcagcccggcggcagcctgagactgagctgcgtggccagcggcttcaccttcagcacctacggcatgcactgggtgagacaggcccccggcaagggcctggagtgggtggccttcatgagattcgacggcagcaacagatactacggcgacagcgtgaagggcagattcaccatcagcagagacaacagcaagaacaccctgtacctgcagatgatcagcctgagagccgaggacaccgccgtgtaccactgcgccaaggacctgggcggcaacaagcccgacgagtgggccaccgactactacgacctgagcatcgcctaccccgtgcaggaccccagagccgtggtgggcgtgttcgacatctggggccagggcaccatcatcaccgtgagcagc

SEQ ID NO: 32676 - RNA, 432 nt, synthetic construct
  misc_feature 1..432: note = derived and/or modified sequence opt4 from anti-HIV_cap256-048-140582_VR-Chain
  source 1..432: mol_type = other RNA
caggtgcagctggtggagagcggcggcggcgtggtgcagcccggcagaagcctgagactgagctgcgccgccagcggcttcagcttcagcaactacgccatggactgggtgagacaggcccccggcaagggcctggagtgggtggccttcgtgagcagcgacggcagcaacaagaactacgccgacagcgtgaagggcagattcaccatcagcagagacaacagcaagaacaccgtgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32677 - RNA, 432 nt, synthetic construct
  misc_feature 1..432: note = derived and/or modified sequence opt4 from anti-HIV_cap256-048-139355_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccatcatcagctacgacggcagcaacaagtactacgccgacagcgtgaagggcagattcaccatcagcagagacaacagcaagggcaccctgtacctgcagatggacggccccagacccgaggacaccgccctgtactactgcgccaaggacctgggcgagagagagtgcgaggagtgggccagcgactactacgacttcggcagagacttcccctgccaggaccccagaggcgtggtgggcaccttcgacatctggggccagggcaccatggtgaccgtgagcagc

SEQ ID NO: 32678 - RNA, 432 nt, synthetic construct
  misc_feature 1..432: note = derived and/or modified sequence opt4 from anti-HIV_cap256-048-139151_VR-Chain
  source 1..432: mol_type = other RNA
caggtgcagctggtggagagcggcggcggcgtggtgcagcccggcaagagcctgagactgagctgcgccgccagcggcttcaccttcaacacctacggcatgcactgggtgagacaggcccccggcaagggcctggagtgggtggccgtgatcagctacgacggcagcatccagaagtacgccgacagcgtgaagggcagattcaccatcagcagagacaacagcaagaacaccctgtacctgcagatgaacagcctgagcgtggaggacaccgccgtgtactactgcgccaaggacctgggcaagaacaaggacgacgagtgggccaccgactactacgacatcagcatcgcctaccccgtgcccgaccccagagccgtggtgggcgtgttcgacatctggggccagggcaccgtggtgaccgtgagcagc

SEQ ID NO: 32679 - RNA, 432 nt, synthetic construct
  misc_feature 1..432: note = derived and/or modified sequence opt4 from anti-HIV_cap256-048-137672_VR-Chain
  source 1..432: mol_type = other RNA
gaggtgcagctggtggagagcggcggcggcgtggccagacccggcggcagcctgagactgagctgcgccgccagcggcttcatcttcacccactacgccatggactgggtgagacaggcccccggcaagggcctggagtgggtggccgtgatcagcagcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32680 - RNA, 432 nt, synthetic construct
  misc_feature 1..432: note = derived and/or modified sequence opt4 from anti-HIV_cap256-048-137506_VR-Chain
  source 1..432: mol_type = other RNA
caggtgagactggtggacagcggcggcggcgtggtgcagcccggcggcagcctgagactgagctgcgccgccagcggcttcaccttcagcacctacggcatgcactgggtgagacaggcccccggcaagggcctggagtgggtggccttcatcagaagcgacggcagcaacaagtactacgccgacagcgtgcagggcagattcagcatcagcagagacaacagcaagaacaccctgtacctgcagatgaacagcctgagagccgaggacaccgccgtgtactactgcgccaaggacctgggcgagagcgacaaggaggagtggcccagcgactactacgacttcggcagagacttcaccggccaggaccccagagccgtggtgggcgtgttcgacatctggggccagggcaccaccgtgatcgtgagcagc

SEQ ID NO: 32681 - RNA, 432 nt, synthetic construct
  misc_feature 1..432: note = derived and/or modified sequence opt4 from anti-HIV_cap256-048-137270_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatgagccccgacggcagcaacagatactacaccgacagcgtgaagggcagattcaccatcagcagagacaacagcaagaacaccctgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32682 - RNA, 432 nt, synthetic construct
  misc_feature 1..432: note = derived and/or modified sequence opt4 from anti-HIV_cap256-048-135447_VR-Chain
  source 1..432: mol_type = other RNA
gaggtgcagctggtggagagcggcggcgccgtggtgcagcccggcagaagcctgagactgagctgcaccgccagcggcttcagcttcaccagctacaccatccactgggtgagacaggcccccggcaagggcctggagtgggtggccttcatcagctacgacggcaccgagaagaagtacaccgacagcgtgaagggcagattcaccatcagcagagacaacagcaagaacaccctgagcctgcagatgaacagcctgagacccgaggacaccgccgtgtactactgcgccaaggacctgggcgccagcaaggacgacgagtgggccaccgactactacgacttcagcatcgcctaccccgtgcaggaccccagagccgtggtgggcgccttcgacatctggggccagggcaccatggtgaccgtgagcagc

SEQ ID NO: 32683 - RNA, 432 nt, synthetic construct
  misc_feature 1..432: note = derived and/or modified sequence opt4 from anti-HIV_cap256-048-131966_VR-Chain
  source 1..432: mol_type = other RNA
caggagcagctggtggagagcggcggcggcgtggtgcagcccggcagaagcctgagactgagctgcgccgccagcggcttcaccttcagcaactacgccatgcactgggtgagacaggcccccggcaagggcctggagtgggtggccgccatgagccacgacggcagcgacaagtactacgccgacagcgtgaagggcagattcaccatcagcagagacaacagcaagaacaccctgtacatgcagatgaacagcctgagagccgaggacaccgccgtgtactactgcgccaaggaccagggcgagagcgagaaggaggagtgggccagcgactactacgacttcggcagagactaccccggccaggaccccagaagagtggtggccaccttcgccatctggggccagggcaccatggtgaccgtgagcagc

SEQ ID NO: 32684 - RNA, 432 nt, synthetic construct
  misc_feature 1..432: note = derived and/or modified sequence opt4 from anti-HIV_cap256-048-131008_VR-Chain
  source 1..432: mol_type = other RNA
gaggtgagactggtggagagcggcggcggcctggtgaagcccggcggcagcctgagactgagctgcgccgccagcggcttcaccgtgagcagcaactacatgagctgggtgagacaggcccccggcaagggcctggagtgggtggccgccatcagcttcgccggcaccaacaagtactacgccgacagcgtgaagggcagattcaccatcagcagagacaacagcaagaacgccctgtacctgcagatgaacagcctgagagccgaggacaccgccctgtactactgcgccaaggacctgagagagagcgagtgcgaggagtgggccagcgactactacgacttcggcagagactacccctgccaggaccccagaggcgtggtgggcaccctggacatctggggccagggcaccatggtgaccgtgagcagc

SEQ ID NO: 32685 - RNA, 432 nt, synthetic construct
  misc_feature 1..432: note = derived and/or modified sequence opt4 from anti-HIV_cap256-048-129369_VR-Chain
  source 1..432: mol_type = other RNA
caggtgcagctggtggagagcggcggcggcgtggtgcagcccggcagaagcctgagactgagctgcgccgccagcggcttcaccttcagcaactacgtgatgcactgggtgagacaggcccccggcaagggcctggagtgggtggccctggtgagcttcgacggcagcaacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32686 - RNA, 432 nt, synthetic construct
  misc_feature 1..432: note = derived and/or modified sequence opt4 from anti-HIV_cap256-048-128476_VR-Chain
  source 1..432: mol_type = other RNA
gaggtgcaggtgctggagagcggcggcggcctggtgcagcccggcggcagcctgagactggcctgcgccgccagcggcttcagcttcagcagctacggcatgcactgggtgagacaggcccccggcaagggcctggagtgggtgagcttcatcagatacgacggcgccaacaagtaccacgccgacagcgtgaagggcagattcatcatcagcagagacgacagcaagaacaccgtgagcctgcagatgaacagcctgagacccgaggacaccgccgtgtactactgcgccaaggacctgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32687 - RNA, 432 nt, synthetic construct
  misc_feature 1..432: note = derived and/or modified sequence opt4 from anti-HIV_cap256-048-128270_VR-Chain
  source 1..432: mol_type = other RNA
caggtgcagctggtggagagcggcggcggcgtggtgcagcccggcagaagcctgagactgagctgcaccgccagcggcttcaccttcagaagctacgccatgcactgggtgagacaggcccccggcaagggcctggagtgggtggccctgatcagctacgacggcagcaacaagtactacgccgacagcgtgaagggcagattcaccatcagcagagacaacagcaagaacaccctgtacctgcagatgaacagcctgaccagcgaggacaccgccgtgtactactgcgccaaggacctgggcggcagcaagaccgacgagtggggcaccgactactacgagttctggaacgcctaccccgtgcaggaccccagagtggtggtgggcgccttcgacatctggggccacggcaccatggtgaccgtgagcagc

SEQ ID NO: 32688 - RNA, 432 nt, synthetic construct
  misc_feature 1..432: note = derived and/or modified sequence opt4 from anti-HIV_cap256-048-126220_VR-Chain
  source 1..432: mol_type = other RNA
caggtgcagctggtggagagcggcggcggcgtggtgcagcccggcagaagcctgagactgagctgcgccgccagcggcttcatcttcagcccctacggcatccactgggtgagacaggcccccggcaagggcctggagtgggtggccctgatcagccacgacggcagcaagaagtactacgccgacagcgtgaagggcagattcaccatcagcagagacaacttcaaggacaccctgtacctgcagatgaacagcctgagaggcgtggacaccgccgtgtactactgcgccaaggacctgggcggcggcgaggtggaggagtgggccaccgactactacgactggagcaccgcctaccccgtggagcaccccagagccgtggtgggcgtgttcgacatctggggccagggcaccaaggtgaccgtgagcagc

SEQ ID NO: 32689 - RNA, 432 nt, synthetic construct
  misc_feature 1..432: note = derived and/or modified sequence opt4 from anti-HIV_cap256-048-125713_VR-Chain
  source 1..432: mol_type = other RNA
gaggtgcagctggtggagagcggcggcggcctggtgcagcccggcggcagcctgagactgagctgcgaggccagcggcttcagcttcagcacctacgagctgaactgggtgagacaggcccccggcaagggcctggagtgggtggccgtgatcagctacgacggcagcaactactactacgccgacagcgtgaagggcagattcaccatcagcagagacaacagcaagaacaccctgtacctgcagatgaacagcctgagagccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32690 - RNA, 432 nt, synthetic construct
  misc_feature 1..432: note = derived and/or modified sequence opt4 from anti-HIV_cap256-048-123934_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatggcctgggtgagacaggcccccggcaagggcctggagtgggtgaccgccatcagcttcgccggcaccaacaagtactacgccgacagcgtgaagggcagattcaccatcagcagagacaacagcaaggacaccctgtacctgcagatggacggcctgagacccgaggacaccgccctgtactactgcgccaaggacctgggcgagagagagtgcgaggagtgggccagcgactactacgacttcggcagagacttccccggccaggaccagagagccgtggccggcgtgttcgacatgtggggccagggcaccatggtgaccgtgagcagc

SEQ ID NO: 32691 - RNA, 432 nt, synthetic construct
  misc_feature 1..432: note = derived and/or modified sequence opt4 from anti-HIV_cap256-048-122673_VR-Chain
  source 1..432: mol_type = other RNA
gaggtgcaggtggtggagagcggcggcggcctggtgaagcccggcggcagcctgagactgagctgcgccgccagcggcttcaccttcagcagccacgtgatgaactgggtgagacaggcccccggcaagggcctggagtgggtgagcagcatcagcggcggcagcagcagcaaggactacgccgacagcgtgaagggcagattcaccatcagcagagacaacagcaagaacaccctgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32692 - RNA, 432 nt, synthetic construct
  misc_feature 1..432: note = derived and/or modified sequence opt4 from anti-HIV_cap256-048-122208_VR-Chain
  source 1..432: mol_type = other RNA
agagtgcaggtggtggagagcggcggcggcgtggtgaagcccggcggcagcctgagactgagctgcggcgccagcggcttcaccttcagcaacgcctggctgagctgggtgagacaggcccccggcaagggcctggagtgggtggccgtgatcagcagcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32693 - RNA, 432 nt, synthetic construct
  misc_feature 1..432: note = derived and/or modified sequence opt4 from anti-HIV_cap256-048-121552_VR-Chain
  source 1..432: mol_type = other RNA
caggtgcagctggtggagagcggcggcggcgtggtgcagcccggcggcagcctgagactgagctgcgccgccagcggcttcaccttcagcagctacgccatgcactgggtgagacaggcccccggcaagggcctgaagtgggtggccgacatcagctacgacgccagcagcaagtactacgccgacagcgtgaagggcagattcaccatcagcagagacaacagcaagaacaccctgtacctggagatgaacagcctgagacccgaggacaccgccgtgtactactgcgccaaggacctgggcgagagagagtgcgaggagtgggccagcgactactacgacttcggcagagacttcccctgccaggaccccagaggcgtggtgggcaccttcgacatctggggccagggcaccatggtgaccgtgagcagc

SEQ ID NO: 32694 - RNA, 432 nt, synthetic construct
  misc_feature 1..432: note = derived and/or modified sequence opt4 from anti-HIV_cap256-048-120643_VR-Chain
  source 1..432: mol_type = other RNA
caggtgcagctggtggagagcggcggcggcgtggtgcagcccggcagaagcctgagactgagctgcgccgccagcggcttcaccctgagcgcctacaccatgcactgggtgagacaggcccccggcaagggcctggagtgggtgagcgtgatcagcttcgccggcaacaacaagtactacgccgacagcgtgaagggcagattcaccatcagcagagagaacagcaagaacatgctgtacctgcagatgaacagcctgagaggcgaggacaccgccgtgtactactgcgccaaggacctgagagagttcgagtgcgaggagtgggccagcgactactacgacttcggcagagactacccctgccaggaccccagaggcgtggtgggcaccttcgacgtgtggggccacggcagcctggtgaccgtgagcagc

SEQ ID NO: 32695 - RNA, 432 nt, synthetic construct
  misc_feature 1..432: note = derived and/or modified sequence opt4 from anti-HIV_cap256-048-118458_VR-Chain
  source 1..432: mol_type = other RNA
caggtgcagctggtggagagcggcggcggcgtggtgcagcccggcagaagcctgagactgagctgcgccgccagcggcttcaccttcagcaccagcggcatgcactgggtgagacaggcccccggcaagggcctggagtgggtggccttcatcagcagcgacagaagcaacaagttctacgccgacagcgtgaagggcagattcagcatcagcagagacaacagcaagtacaccctgtacctgcagatgaacagcctgagagccgacgacaccgccgtgtacttctgcgccaaggacctgggcgtgaacaagaacgacgagtgggccaccgactactacgacctgagcgtggcctaccccgtgcaggaccccagaggcgtggccggcatcttcgacatctggggccagggcaccatggtgaccgtgagcagc

SEQ ID NO: 32696 - RNA, 432 nt, synthetic construct
  misc_feature 1..432: note = derived and/or modified sequence opt4 from anti-HIV_cap256-048-118112_VR-Chain
  source 1..432: mol_type = other RNA
caggagcagctggtggagagcggcggcggcgtggtgcagcccggcagaagcctgagactgagctgcgccgccagccagttcaccttcagcaactacggcatgcactgggtgagacaggcccccggcaagggcctggtgtgggtggccggcatcagcttcgccggcaccaacaagtactacgccgccagcgtgaagggcagattcaccatcagcagagacaacagcaagaacaccctgtacctgcagatgaacagcctgagagccgaggacaccgccctgtactactgcgccaaggacatgagagagtacgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32697 - RNA, 432 nt, synthetic construct
  misc_feature 1..432: note = derived and/or modified sequence opt4 from anti-HIV_cap256-048-116469_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccatcatcagctacgacggcagcaacaagtactacgccgacagcgtgaagggcagattcaccatcagcagagacaaccccaagaacaccctgtacctgcagatgaacagcctgagagccgaggacaccggcctgtactactgcgccaaggacatgggcgagagcgagaaggaggagtgggccagcgactactacgacttcggcagagactaccccggccaggagcccagagccatggtgggcaccttcgacatctggggccagggcaccatggtgaccgtgagcagc

SEQ ID NO: 32698 - RNA, 432 nt, synthetic construct
  misc_feature 1..432: note = derived and/or modified sequence opt4 from anti-HIV_cap256-048-113917_VR-Chain
  source 1..432: mol_type = other RNA
gaggtgcagctggtggagagcggcggcggcctggtgcagcccggcggcagcctgagactgagctgcgccgccagcggcctgaccgtgagcgacacctacatgaactggctgagacaggcccccggcaagggcctggagtgggtggccgtggtgagcagcgacggcagcaacaagaactacgccgacagcgtgaagggcagattcaccatcagcagagacaacagcaagaacaccgtgtacctgcagatgaacagcctgagagccgaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32699 - RNA, 432 nt, synthetic construct
  misc_feature 1..432: note = derived and/or modified sequence opt4 from anti-HIV_cap256-048-112368_VR-Chain
  source 1..432: mol_type = other RNA
caggtgcagctggtggagagcggcggcggcgtggtgcagcccggcagaagcctgagactgagctgcgccgccagcggcttcaccttcagcagaaacgccatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcggcggcgaggtggaggagtgggccaccgactactacgactggagcaccgcctaccccgtggagcaccccagagccgtggtgggcgtgttcgacatctggggccagggcaccaaggtgaccgtgagcagc

SEQ ID NO: 32700 - RNA, 432 nt, synthetic construct
  misc_feature 1..432: note = derived and/or modified sequence opt4 from anti-HIV_cap256-048-112047_VR-Chain
  source 1..432: mol_type = other RNA
gaggtgcagctggtggagagcggcggcggcctggtgcagcccggcggcagcctgagactgagctgcgccgccagcggcctgaccgtgagcggctactacatgagctgggtgagacaggcccccggcaagggcctggagtggctggccttcatccacttcgacggcagcaagatccactacgccggcagcgtgaagggcagaatcaccgtgagcagagacaacagcaagaacaccctggacctgcagatgaacagcctgagagccgaggacaccgccgtgtactactgcgccaaggacgtgggcgacagcaagagcgacgagtgggccaccgactactacgacctgagcgtggcctaccccgtgcccgaccccagagccgtggtgggcgccttcgacatctggggccagggcaccatggtgaccgtgagcagc

SEQ ID NO: 32701 - RNA, 432 nt, synthetic construct
  misc_feature 1..432: note = derived and/or modified sequence opt4 from anti-HIV_cap256-048-112029_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccggcatcagcttcgccggcatcaagaagtactacgccgacagcgtgaagggcagattcaccatcagcagagacaacagcaagaacaccctgtacctgcagatgaacagcctgagaggcgaggacaccgccctgtactactgcgccaaggacctgagagagtacgagtgcgaggagtgggccagcgactactacgacttcggcagagactacccctgccaggaccccagaggcgtggtgggcatcttcgacatctggggccagggcaccatggtgaccgtgagcagc

SEQ ID NO: 32702 - RNA, 432 nt, synthetic construct
  misc_feature 1..432: note = derived and/or modified sequence opt4 from anti-HIV_cap256-048-110957_VR-Chain
  source 1..432: mol_type = other RNA
caggtgagactggtggagagcggcggcggcgtggtgagaagcggcagaagcctgagactgagctgcgccgccagcggcttcaccttcagcaacttcgccctgcactgggtgagacaggcccccggcaagggcctggagtgggtggccgtgatcagctacgacggcaacagcaagttctacgccgacagcgtgaagggcagattcaccatcagcaccgacaacagcaagaacaccctgtacctgcagatgaacagcctgaccgccgaggacaccgccgtgtactactgcgccaaggacctgggcggcaacaaggacgacgagtggggcaccgactactacgacttcagcgtggcctaccccgtgcaggaccccagagccgtgagcggcatcttcgacgtgtggggccacggcaccatggtgaccgtgagcagc

SEQ ID NO: 32703 - RNA, 432 nt, synthetic construct
  misc_feature 1..432: note = derived and/or modified sequence opt4 from anti-HIV_cap256-048-110526_VR-Chain
  source 1..432: mol_type = other RNA
caggtgcagctggtggagagcggcggcggcgtggtgcagcccggcagaagcctgagactgagctgcgccgccagcggcttcaccttcagcaacttcggcttccactgggtgagacaggcccccggcaagggcctggagtgggtggccgccatcagcttcgccggcaacaacaagtactacgccgacagcgtgaagggcagattcaccatcagcagagagaacagcaagaacatcctgtacctgcagatgaacagcctgagaggcgaggacaccgccgtgtactactgcgccaaggacctgagagagttcgagtgcgaggagtgggccagcgactactacgactggagcaccgcctaccccgtggagcaccccagagccgtggtgggcgtgttcgacatctggggccagggcaccaaggtgaccgtgagcagc

SEQ ID NO: 32704 - RNA, 432 nt, synthetic construct
  misc_feature 1..432: note = derived and/or modified sequence opt4 from anti-HIV_cap256-048-109336_VR-Chain
  source 1..432: mol_type = other RNA
gaggtgcagctggtggagagcggcggcggcctggtgcagcccggcggcagccagagactgagctgcgccgccagcggcctgaccgtgaacagcaactacatgacctgggtgagacaggcccccggcaagggcctggagtgggtggccatcatcagcagcgacggcagcggccagtactacgccgacagcgtgaagggcagattcaccatcagcagagacaacagcaagaacaccctgagcctgcagatgaacagcctgagacccgaggacaccgccgtgtactactgcgccaaggacctgggcgccagcaaggacgacgagtgggccaccgactactacgacttcagcatcgcctaccccgtgcaggaccccagagccgtggtgggcgccttcgacatctggggccagggcaccatggtgaccgtgagcagc

SEQ ID NO: 32705 - RNA, 432 nt, synthetic construct
  misc_feature 1..432: note = derived and/or modified sequence opt4 from anti-HIV_cap256-048-108152_VR-Chain
  source 1..432: mol_type = other RNA
caggcccagctggtggagagcggcggcggcgtggtgcagcccggcagaagcctggtgctgagcagcgtggccagcggcttcagcttcagcacctacgccatgcactgggtgagacaggcccccggcaagggcctggagtgggtggccgtgatcagctacgacggcggcaacaagtactacgccgacagcgtgaagggcagattcagcatcagcagagacaacagcaagaacaccgtgtacctgcagatcaacagcctgagagccgaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32706 - RNA, 432 nt, synthetic construct
  misc_feature 1..432: note = derived and/or modified sequence opt4 from anti-HIV_cap256-048-107799_VR-Chain
  source 1..432: mol_type = other RNA
gaggtgcaggtggtggagagcggcggcggcgtggtgcagcccggcagaagcctgagactgagctgcgccgccagcggcttcaccttcagcaactacgccatggactgggtgagacaggcccccggcaagggcctggagtgggtggccttcgtgagcagcgacggcagcaacaagaactacgccgacagcgtgaagggcagattcaccatcagcagagacaacagcaagaacaccctgagcctgcagatgaacagcctgagagccgaggacaccgccgtgtactactgcgccaaggaggtgggcgagaacaaggacgacgagtgggccagcgactactacgacctgagcatcgcctaccccatccacgaccccagagccgtggtgggcggcttcgacatctggggccagggcaccatggtgaccgtgagcagc

SEQ ID NO: 32707 - RNA, 432 nt, synthetic construct
  misc_feature 1..432: note = derived and/or modified sequence opt4 from anti-HIV_cap256-048-107384_VR-Chain
  source 1..432: mol_type = other RNA
gaggtgagactggtggagagcggcggcgccctggtgaagcccggcaccagcctgagactgagctgcgccgccagcggcttcaccttcacccactacgccatggactgggtgagacaggcccccggcaagggcctggagtgggtggccatcatcagcagcgacggcagcaccaagaactacgccgacagcgtgaagggcagattcaccatcagcagagacaacagcaagaacaccctgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32708 - RNA, 432 nt, synthetic construct
  misc_feature 1..432: note = derived and/or modified sequence opt4 from anti-HIV_cap256-048-106530_VR-Chain
  source 1..432: mol_type = other RNA
gaggtgcagctgctggagagcggcggcggcctggtgcagcccggcggcagcctgagactgagctgcgccgccagcggcttcaccttcagcagctacgccatggactgggtgagacaggcccccggcaagggcctggagtgggtggccgtgatcagcagcgacggcagcaacaagaactacgccgacagcgtgaagggcagattcaccatcagcagagacaacagcaagaacaccctgtacctgcagatgagcagcctgagacccgaggacaccgccgtgtactactgcgccaaggacgtgggcgacagcaagagcgacgagtgggccaccgactactacgacttcagcatcgcctaccccatccaggaccccagagccgtggtgggcgccttcgacatctggggccagggcaccatggtgaccgtgagcagc

SEQ ID NO: 32709 - RNA, 432 nt, synthetic construct
  misc_feature 1..432: note = derived and/or modified sequence opt4 from anti-HIV_cap256-048-106464_VR-Chain
  source 1..432: mol_type = other RNA
gaggtgcagatggtgcagagcggcggcggcctggtgcagcccggcggcagcctgagactgagctgcgccgccttcggcttcaccttcaccaaccacgccatggactgggtgagacaggtgcccggcaagggcctggagtgggtggccttcatcagcagcgacggcagcaacaagaactacgccgacagcgtgaagggcagattcaccatcagcagagacaacagcaagaacaccgtgtacctgcagatgagcagcctgagacccgaggacaccgccgtgtactactgcgccaaggacgtgggcgacagcaagagcgacgagtgggccaccgactactacgacctgagcgtggcctaccccgtgcccgaccccagagccgtggtgggcgccttcgacatctggggccagggcaccatggtgaccgtgagcagc

SEQ ID NO: 32710 - RNA, 432 nt, synthetic construct
  misc_feature 1..432: note = derived and/or modified sequence opt4 from anti-HIV_cap256-048-106411_VR-Chain
  source 1..432: mol_type = other RNA
caggtgcagctggtggagagcggcggcggcgtggtgcagcccggcagaagcctgagactgagctgcgccgccagcggcttcaccttcagctacagcggcatgcactgggtgagacaggcccccggcaagggcatggagtgggtggccgtgatcagctacgacggcagcaacaagtactacgccgacagcgtgaagggcagattcaccatcagcagagacaacagcaagaacaccctgtacctgcagatgaacagcctgagagtggaggacaccgccgtgtaccactgcgccaaggacctgggcggcaccaagagcgacgagtgggccaccgactactacgacctgagcatcgcctaccccatccaggaccccggcgccgtggtgggcgtgttcgacatctggggccagggcaccatggtgaccgtgagcagc

SEQ ID NO: 32711 - RNA, 432 nt, synthetic construct
  misc_feature 1..432: note = derived and/or modified sequence opt4 from anti-HIV_cap256-048-106306_VR-Chain
  source 1..432: mol_type = other RNA
gaggtgcagctggtggagagcggcggcggcctggtgcagcccggcggcagcctgagactgagctgcgaggccagcggcttcaccttcaacaactacggcatggtgtgggtgagacaggcccccggcaagggcctggagtgggtggccatcatcagctacgacggcaccgagaagtactacgtggacagcgtgaagggcagattcaccatcagcagagacaacagcaagaacaccctgagcctgcagatgaacagcctgagagccgaggacaccgccgtgtactactgcgccaaggaggtgggcgagaacaaggacgacgagtgggccagcgactactacgacctgagcatcgcctaccccatccacgaccccagagccgtggtgggcggcttcgacatctggggccagggcaccatggtgaccgtgagcagc

SEQ ID NO: 32712 - RNA, 432 nt, synthetic construct
  misc_feature 1..432: note = derived and/or modified sequence opt4 from anti-HIV_cap256-048-104496_VR-Chain
  source 1..432: mol_type = other RNA
caggtgcagctggtggagagcggcggcggcctggtgaagcccggcggcagcctgagactgagctgcgccgccagcggcttcaccttcagcagctacggcatgcactgggtgagacaggcccccggcaagggcctggagtgggtggccttcgtgagcagcgacggcaacaacaagaactacgccgacagcgtgaagggcagattcaccatcagcagagacaacagcaagaacaccgtgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32713 - RNA, 432 nt, synthetic construct
  misc_feature 1..432: note = derived and/or modified sequence opt4 from anti-HIV_cap256-048-103074_VR-Chain
  source 1..432: mol_type = other RNA
caggtgcacctggtggagagcggcgccggcgtggtgcagcccggcggcagcctgagactgagctgcgccgtgagcggcttcaccttcaacagctacggcatgcactgggtgagacaggcccccggcaagggcctggagtgggtggccgtgatcagctacgacggcagcgacaagtactacgccgacagcgtgaagggcagattcaccatcagcagagacagcagcaagaacaccctgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32714 - RNA, 432 nt, synthetic construct
  misc_feature 1..432: note = derived and/or modified sequence opt4 from anti-HIV_cap256-048-100832_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtggtgagcagcgacggcaccaacaagaactacggcgacagcgtgaagggcagattcaccatcagcagagacaacagcagaaacaccgtgtacctgcagatgagcagcctgagacccgaggacaccgccgtgtactactgcgccaaggacgtgggcgacaccaagagcgacgagtgggccaccgactactacgacttcagcatcgcctaccccgtgcaggaccccagagccgtggtgggcgccttcgacatctggggccagggcaccatggtgaccgtgagcagc

SEQ ID NO: 32715 - RNA, 432 nt, synthetic construct
  misc_feature 1..432: note = derived and/or modified sequence opt4 from anti-HIV_cap256-048-100188_VR-Chain
  source 1..432: mol_type = other RNA
caggtgcacctggtggagagcggcggcggcgtggtgcagcccggcagaagcctgagaatctactgcgccgtgagcgagttcaccttcagaaactacgccatgcactgggtgagactggcccccggcaagggcctgcagtgggtggccgtgatcagctacaacggcggcaagaagtactacgccgacagcgtgaagggcagattcaccatcagcagagacaacagcaagaacgccctgtacctgcagatgaacagcctgagagccgaggacaccggcctgtactactgcgccaaggacctgagagagttcgagtgcgaggagtgggccagcgactactacgacttcggcagagagtacccctgccaggaccccagaggcgtggtgggcaccttcgacatctggggccagggcaccatggtgaccgtgagcagc

SEQ ID NO: 32716 - RNA, 432 nt, synthetic construct
  misc_feature 1..432: note = derived and/or modified sequence opt4 from anti-HIV_cap256-048-099645_VR-Chain
  source 1..432: mol_type = other RNA
caggtgcagctggtggagagcggcggcggcgtggtgcagcccggcagaagcctgagactgagctgcgccgccagcggcttcaccttcagcagatacgccctgcactgggtgagacaggcccccggcaagggcctggagtgggtggccgtgatcagctacgacggcagcagcaagtactacgccgacagcgtgaagggcagattcagcatcagcagagacaacagcaagtacaccctgtacctgcagatgaacagcctgagagccgacgacaccgccgtgtacttctgcgccaaggacctgggcgtgaacaagaacgacgagtgggccaccgactactacgacctgagcgtggcctaccccgtgcaggaccccagaggcgtggccggcatcttcgacatctggggccagggcaccatggtgaccgtgagcagc

SEQ ID NO: 32717 - RNA, 432 nt, synthetic construct
  misc_feature 1..432: note = derived and/or modified sequence opt4 from anti-HIV_cap256-048-098137_VR-Chain
  source 1..432: mol_type = other RNA
caggtgcagctggtggagagcggcggcggcgtggtgcagcccggcagaagcctgagactgagctgcgccgccagcggcttcaccctgagaaactacgccatgcactgggtgagacaggcccccggcaagggcctggagtgggtggccgtgatcagcagcgacggcaacaacaagtactacgccgacagcgtgaagggcagattcaccgtgagcagagacaacagcaaggacaccctgtacctgcagatgaacagcctgagacccgaggacaccgccctgtactactgcgccaaggacctgggcgagagagagtgcgaggagtgggccagcaactactacgacttcggcagagactacccctgccaggaccccagaggcgtggtgggcaccttcgacatctggggccagggcaccatggtgaccgtgagcagc

SEQ ID NO: 32718 - RNA, 432 nt, synthetic construct
  misc_feature 1..432: note = derived and/or modified sequence opt4 from anti-HIV_cap256-048-097878_VR-Chain
  source 1..432: mol_type = other RNA
caggtgcagctgctggagagcggcggcggcgtggtgcagcccggcaagagcctgagactgagctgcgccgccagcggcttcaccttcaacacctacggcatgcactgggtgagacaggcccccggcaagggcctgcagtgggtggccgtgatcagctacgacggcaccatccagaagtacgccgacagcgtgaagggcagattcaccatcagcagagagaacagcaagaacatgctgtacctgcagatgaacagcctgagaggcgaggacaccgccgtgtactactgcgccaaggacctgagagagttcgagtgcgaggagtgggccagcgactactacgacttcggcagagactacccctgccaggaccccagaggcgtggtgggcaccttcgacgtgtggggccacggcagcctggtgaccgtgagcagc

SEQ ID NO: 32719 - RNA, 432 nt, synthetic construct
  misc_feature 1..432: note = derived and/or modified sequence opt4 from anti-HIV_cap256-048-097510_VR-Chain
  source 1..432: mol_type = other RNA
caggtgcagctggtggagagcggcggcggcgtggtgcagcccggcagaagcctgtggctgagctgcgccgccagcgagttcaccctgagaagctacggcatgcactgggtgagacaggcccccggcaagggcctggagtgggtggccttcgtggccttcgacgagagcgacaagtactacgccgacagcgtgaagggcagattcaccatcagcagagacaacagcaagaacaccctgagcctgcagatgaacagcctgagagccgaggacaccgccgtgtactactgcgccaaggaggtgggcgacaacaaggacgacgagtgggccagcgactactacgacctgagcatcgcctaccccgtgcacgaccccagagccgtggtgggcggcttcgacatctggggccagggcaccatggtgaccgtgagcagc

SEQ ID NO: 32720 - RNA, 432 nt, synthetic construct
  misc_feature 1..432: note = derived and/or modified sequence opt4 from anti-HIV_cap256-048-097313_VR-Chain
  source 1..432: mol_type = other RNA
caggtgcagctggtggagagcggcggcggcctggtgcagcccggcggcgccctgagactgagctgcctggtgagcggcttcaccttcgacgactacgccctgcactgggtgagacaggcccccggcaagggccccgagtgggtggccgtgctgagcagcgacggcagctacaagtactacaccgagagcgtgcagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32721 - RNA, 432 nt, synthetic construct
  misc_feature 1..432: note = derived and/or modified sequence opt4 from anti-HIV_cap256-048-096626_VR-Chain
  source 1..432: mol_type = other RNA
gaggtgcagctggtggagagcggcggcggcctggtgcagcccggcgagagcctgagactgagctgcgccggcagcggcttcaccttcagcagctactggatgagctgggtgagacaggcccccggcaagggcctggagtggatggccctgatcagctacgacggcagcaacaagtactacgtggacagcgtgaagggcagattcaccatcagcagagacaacagcaagaacaccctgtacctgcagatgaacagcctgagagccgaggacaccgccgtgtactactgcgccaaggacctgggcggcaacaaggacgacgagtgggccaccgactactacgacctgagcatcgcctaccccgtgcaggaccccagagtggtggtgggcatcttcgacatctggggccagggcaccatggtgaccgtgagcagc

SEQ ID NO: 32722 - RNA, 432 nt, synthetic construct
  misc_feature 1..432: note = derived and/or modified sequence opt4 from anti-HIV_cap256-048-096483_VR-Chain
  source 1..432: mol_type = other RNA
gaggtgcagctggtggagagcggcggcggcctggtgcagcccggcagaagcctgagactgagctgcgccgccagcggcttcagcttcgaggactacgccatgcactgggtgagacaggcccccggcaagggcctggagtgggtggccggcatcagcttcgccggcaccaagaagtactacgccgacagcgtgaagggcagattcaccatcagcagagacaacagcaagaacgccctgtacctgcagatgaacagcctgagagccgaggacaccgccctgtactactgcgccaaggacctgagagagtacgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32723 - RNA, 432 nt, synthetic construct
  misc_feature 1..432: note = derived and/or modified sequence opt4 from anti-HIV_cap256-048-095691_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatggcctgggtgagacaggcccccggcaagggcctggagtgggtgaccgccatcagcttcgccggcaccaacaagtactacgccgacagcgtgaagggcagattcaccatcagcagagacaacagcaaggacaccctgtacctgcagatggacggcctgagacccgaggacaccgccctgtactactgcgccaaggacctgggcgagagagagtgcgaggagtgggccagcaactactacgacttcggcagagactacccctgccaggaccccagaggcgtggtgggcaccttcgacatctggggccagggcaccatggtgaccgtgagcagc

SEQ ID NO: 32724 - RNA, 432 nt, synthetic construct
  misc_feature 1..432: note = derived and/or modified sequence opt4 from anti-HIV_cap256-048-095525_VR-Chain
  source 1..432: mol_type = other RNA
caggtgcagctggtgcagagcggcggcagcgtggtgcagcccggcaagagcctgagactgagctgcgccgccagcggcttcaccttcagcagcttcggcatgcactgggtgagacagacccccggcaagggcctggagtgggtggccgtgatcagctacgacggcagcgagaagagctacgccgacagcgtgaagggcagattcaccatcagcagagacaacagcaagaacaccctgtacctgcagatgaacagcctgagagccgaggacaccgccgtgtactactgcgccaaggacctgggcggcaccaaggacgacgagtgggccaccgactactacgacatcagcatcgcctaccccgtgcaggaccccagagccgtggccggcgccttcgacatctggggccagggcaccatggtgaccgtgagcagc

SEQ ID NO: 32725 - RNA, 432 nt, synthetic construct
  misc_feature 1..432: note = derived and/or modified sequence opt4 from anti-HIV_cap256-048-094783_VR-Chain
  source 1..432: mol_type = other RNA
gaggtgcagctggtggagagcggcggcggcctggtgaagcccggcggcagcctgagactgagctgcgccgccagcggcatcaccttcagcacctacgagatgaactgggtgagacaggcccccggcaagggcatggagtgggtggccgtgatcagctacgacggcagcaacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32726 - RNA, 432 nt, synthetic construct
  misc_feature 1..432: note = derived and/or modified sequence opt4 from anti-HIV_cap256-048-094356_VR-Chain
  source 1..432: mol_type = other RNA
caggtgcagctggtggagagcggcggcggcgtggtgcagcccggcagaagcctgagactgagctgcgccgccagcggcttcatcttcacccactacgccatggactgggtgagacaggcccccggcaagggcctggagtgggtggccgtgatcagcagcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacgtgggcgacaacaagagcgacgagtgggccaccgactactacgacttcagcatcgcctaccccgtgcccgaccccagagccgtggtgggcgccttcgacctgtggggccagggcaccatggtgaccgtgagcagc

SEQ ID NO: 32727 - RNA, 432 nt, synthetic construct
  misc_feature 1..432: note = derived and/or modified sequence opt4 from anti-HIV_cap256-048-090756_VR-Chain
  source 1..432: mol_type = other RNA
caggtgcagctggtggagagcggcggcggcgtggtgagacccggcagaagcctgagactgagctgcgccgtgagcggcttcaccttcagcaactacgccatccactgggtgagacaggcccccggcaagggcctggagtgggtggccgtgatcagctacgacggcagcgacaagtactacgccgacagcgtgaagggcagattcaccatcagcagagagaacagcaagaacatgctgtacctgcagatgaacagcctgagaggcgaggacaccgccgtgtactactgcgccaaggacctgagagagttcgagtgcgaggagtgggccagcgactactacgacttcggcagagactacccctgccaggaccccagaggcgtggtgggcaccttcgacgtgtggggccacggcagcctggtgaccgtgagcagc

SEQ ID NO: 32728 - RNA, 432 nt, synthetic construct
  misc_feature 1..432: note = derived and/or modified sequence opt4 from anti-HIV_cap256-048-089065_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccctgatcagctacgacggcaccaacaagtactacgtggacagcgtgaagggcagattcaccatcagcagagacaacagcaagaacaccctgtacctgcagatgaacagcctgaccgccgaggacaccgccgtgtactactgcgccaaggacctgggcggcaacaaggacgacgagtggggcaccgactactacgacttcagcgtggcctaccccgtgcaggaccccagagccgtgagcggcatcttcgacgtgtggggccacggcaccatggtgaccgtgagcagc

SEQ ID NO: 32729 - RNA, 432 nt, synthetic construct
  misc_feature 1..432: note = derived and/or modified sequence opt4 from anti-HIV_cap256-048-084986_VR-Chain
  source 1..432: mol_type = other RNA
caggtgcagctggtggagagcggcggcggcgtggtgcagcccggcagaagcctgagactgagctgcgccgccagcggcttcaccttcagcgactacgccatgcactgggtgagacaggcccccggcaagggcctggagtgggtggccctgatcagctacgacggcagcaacaagtactacgccgacagcgtgaagggcagattcaccatcagcagagacaacagcaagaacaccctgtacctgcagatgagcagcctgaccgccgaggacaccgccgtgtactactgcgccaaggacctgggcggcaacaagaacgacgagtgggccaccgactactacgacctgagcatcgcctaccccatccacgaccccagagccgtgctgggcgccttcgacgtgtggggccagggcaccatgctgaccgtgagcagc

SEQ ID NO: 32730 - RNA, 432 nt, synthetic construct
  misc_feature 1..432: note = derived and/or modified sequence opt4 from anti-HIV_cap256-048-083355_VR-Chain
  source 1..432: mol_type = other RNA
caggtgcagctggtggagagcggcggcggcgtggtgcagcccggcagaagcctgagactgagctgcgccgtgagcggcttcatcttcagcagctacgccatgagatgggtgagacaggcccccggcaagggcctggagtgggtggccgtgatcagctacgacggcagcaagaccaactacgccgacagcgtgaagggcagattcaccatcagcagagacaacagcaagaacaccctgtacctgcagatgaacagcctgaccagcgaggacaccgccgtgtactactgcgccaaggacctgggcggcagcaagaccgacgagtggggcaccgactactacgagttctggaacgcctaccccgtgcaggaccccagagtggtggtgggcgccttcgacatctggggccacggcaccatggtgaccgtgagcagc

SEQ ID NO: 32731 - RNA, 432 nt, synthetic construct
  misc_feature 1..432: note = derived and/or modified sequence opt4 from anti-HIV_cap256-048-082462_VR-Chain
  source 1..432: mol_type = other RNA
caggtgcacctggtggagagcggcggcggcgtggtgcagcccggcaagagcctgagactgagctgcaccgccagcagattcatcttcagaaactacgccatggactgggtgagacaggcccccggcaagggcctggagtgggtggccgtgatcagctacgacggcgtgaaggagcactacgccgagagcgtgaagggcagattcaccatcagcagagacaacagcaagaacaccgtgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32732 - RNA, 432 nt, synthetic construct
  misc_feature 1..432: note = derived and/or modified sequence opt4 from anti-HIV_cap256-048-082246_VR-Chain
  source 1..432: mol_type = other RNA
caggtgcacctggtggagagcggcggcggcgtggtgcagcccggcagaagcctgagaatcagctgcgccgccagcggcttcaccttcagcaagaacgccatgcactgggtgagacaggcccccggcaagggcctggagtgggtggccttcgtggccttcgacgagagcgacaagtactacgccgacagcgtgaagggcagattcaccatcagcagagacaacagcaagaacatcctgagcctgcagatgaacagcctgagagccgaggacaccgccgtgtactactgcgccaaggaggtggacgagtacaaggacgacgagtgggccagcgactactacgacctgagcatcgcctaccccgtgagagaccccagagccgtggtgggcggcttcgacatctggggccagggcaccatggtgaccgtgagcgcc

SEQ ID NO: 32733 - RNA, 432 nt, synthetic construct
  misc_feature 1..432: note = derived and/or modified sequence opt4 from anti-HIV_cap256-048-080752_VR-Chain
  source 1..432: mol_type = other RNA
caggtgcagctggtggagagcggcggcggcgtggtgcagcccggcggcagcctgagactgagctgcgccgccagcggcttcaccttcagcaactacggcatgcactgggtgagacaggcccccggcaagggcctggagtgggtggccttcatcagatacgacggcgacatcacctactacgtggacagcgtgaagggcagattcaccatcagcagagacaacagcaagaacgccctgtacctgcagatgaacagcctgagagccgaggacaccgccctgtactactgcgccaaggacctgagagagtacgagtgcgaggagtgggccagcgactactacgacttcggcagagagtacccctgccaggaccccagaggcgtggtgggcaccttcgacatctggggccagggcaccatggtgaccgtgagcagc

SEQ ID NO: 32734 - RNA, 435 nt, synthetic construct
  misc_feature 1..435: note = derived and/or modified sequence opt4 from anti-HIV_cap256-048-078409_VR-Chain
  source 1..435: mol_type = other RNA
caggtgcagctggtggagagcggcggcggcgtggtgcagcccggcagaagcctgagactgagctgcgccgccagcggcttcaccttcaacaactacgccatggactgggtgagacaggcccccggcaagggcctggagtgggtggccctgatcagctacgacggcagcaacaagtactacgccgagagcgtgaagggcagattcaccatcagcagagacaacagcaagaacaccctgtacctgcagatgaacagcctgagagccgaggacaccgccgtgtactactgcgccaaggacgtgggcgagaagcagagcatgatgagatgggccaccgactactacgacctgagcatcgcctaccccgtgcccgaccccagagccgtggtgggcgccttcgacctgtggggcagaggcaccatggtgaccgtgagcagc

SEQ ID NO: 32735 - RNA, 432 nt, synthetic construct
  misc_feature 1..432: note = derived and/or modified sequence opt4 from anti-HIV_cap256-048-078273_VR-Chain
  source 1..432: mol_type = other RNA
gaggtgcagctggtggagagcggcggcggcctggtgcagcccggcggcagcctgagactgagctgcgccgccagcggcttcaccgtgagcagcaactacatgagctgggtgagacaggcccccggcaagggcctggagtgggtggccgtgatcagcagcgacggcagcaacaagaactacgccgacagcgtgaagggcagattcaccatcagcagagacaacagcaagaacaccctgttcctgcagatgaacagcctgagacccgaggacaccgccgtgtacttctgcgccaaggacctgggcgccaacaaggacgacgagtgggccaccgactactacgacctgagcatcgcctaccccgtgcacgaccccagagccgtggtgggcatcttcgacctgtggggccagggcaccatggtgaccgtgagcagc

SEQ ID NO: 32736 - RNA, 432 nt, synthetic construct
  misc_feature 1..432: note = derived and/or modified sequence opt4 from anti-HIV_cap256-048-078062_VR-Chain
  source 1..432: mol_type = other RNA
gacgtgtacctggtggagagcggcggcggcctggtgcagcccggcggcagcctgagactgagctgcaccgccagcggcatcaccttcagcacctacgagatgaactgggtgagacaggcccccggcaagggcctggagtgggtggccttcgtggccttcgacggcagcgacaagtactacgccgacagcgtgaagggcagattcgtgatcagcagagacaacagcaagaacaccctgagcctgcagatgaacagcctgagagccgaggacaccgccgtgtactactgcgccaaggaggtgggcgaggacaaggacgacgagtgggccagcgactactacgacctgagcatcgcctaccccgtgcacgaccccagagccgtggtgggcggcttcgacatctggggccagggcaccatggtgaccgtgagcagc

SEQ ID NO: 32737 - RNA, 432 nt, synthetic construct
  misc_feature 1..432: note = derived and/or modified sequence opt4 from anti-HIV_cap256-048-077798_VR-Chain
  source 1..432: mol_type = other RNA
caggtgcagctggtggagagcggcggcggcgtggtgcagcccggcagaagcctgagactgagctgcgccgccagcggcttcaccttcagcaactacggcatgcactgggtgagacagacccccggcaagggcctggagtgggtggccgtgatcagctacgacggcagcaacaagttctacgccgacagcgtgaagggcagattcaccatcagcagagacaacagcaagaacaccctgtacctgcagatgaacagcctgagagtggaggacaccgccgtgtaccactgcgccaaggacctgggcggcagcaagagcgacgagtgggccaccgactactacgactggagcatcgcctaccccgtgcacgaccccagagccgtggtgggcgtgttcgacatctggggccagggcaccctggtgaccgtgagcagc

SEQ ID NO: 32738 - RNA, 432 nt, synthetic construct
  misc_feature 1..432: note = derived and/or modified sequence opt4 from anti-HIV_cap256-048-073853_VR-Chain
  source 1..432: mol_type = other RNA
gaggtgcagctggtggagagcggcggcggcctggtgaagcccggcggcagcctgagactgagctgcgccgccagcggcttcaccttcagcgacgcctggatgaactgggtgagacaggcccccggcaagggcctggagtgggtggccggcatcagcttcgccggcaccaacaagtactacgccgacagcgtgaagggcagattcaccatcagcagagacaacagcaagaacaccctgtacctgcagatgaacagcctgagagccgaggacaccgccctgtactactgcgccaaggacatgagagagtacgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32739 - RNA, 435 nt, synthetic construct
  misc_feature 1..435: note = derived and/or modified sequence opt4 from anti-HIV_cap256-048-071661_VR-Chain
  source 1..435: mol_type = other RNA
caggtgcagctggtggagagcggcggcggcgtggtgcagcccggcagaagcctgggcctgagctgcgaggtgagcggcttcaccttcagcgactacttcatgagctggatcagacaggcccccggcaagggcctggagtgggtggccgtgatcagccacgacggcaacaacaagtactaccccgacagcgtgcagggcagattcaccatcagcagagagaacagcaagaacaccctgtacctgcagatgaacagcctgaagcccgaggacaccgccgtgtacttctgcgccaaggacctgggcggcgagagcgaggtggaggagtgggccagcgactactacgacttcggcagagacatccccggccccgaccccagaggcgtggtgggcaccctggacatctggggccacggcaccatggtgaccgtgagcagc

SEQ ID NO: 32740 - RNA, 432 nt, synthetic construct
  misc_feature 1..432: note = derived and/or modified sequence opt4 from anti-HIV_cap256-048-071360_VR-Chain
  source 1..432: mol_type = other RNA
caggtgcagctggtggagagcggcggcggcgtggtgcagcccggcagaagcctgagactgagctgcgccgccagcggcttcaccctgaccaactacgccatggactgggtgagacaggcccccggcaagggcctggagtgggtggccgtgatcagcagcgacggcagcaacaagaactacgaggacagcgtgaagggcagattcaccatcagcagagacaacagcaagaacaccctgtacctgcagatgagcagcctgagacccgaggacaccgccgtgtactactgcgccaaggacgtgggcgacaacaagagcgacgagtgggccaccgactactacgacttcagcatcgcctaccccgtgcccgaccccagagccgtggtgggcgccttcgacctgtggggccagggcaccatggtgaccgtgagcagc

SEQ ID NO: 32741 - RNA, 432 nt, synthetic construct
  misc_feature 1..432: note = derived and/or modified sequence opt4 from anti-HIV_cap256-048-070955_VR-Chain
  source 1..432: mol_type = other RNA
gaggtgcagctggtggagagcggcggcggcctggtgcagcccggcggcagcgtgagactgagctgcgccgtgagcggcttcaccttcagcagctactggatgagctgggtgagacaggcccccggcaagggcctggagtgggtggccgtgatcagcgacagcggcagcaacaagtactacgccgacagcgtgaagggcagattcaccatcagcagagacaacagcaagaacaccctgtacctgcagatgaacagcctgagagccgaggacaccgccgtgtacttctgcgccaaggacctgggcggcagagagaccgaggagtgggccagcgactactacgacttcggcagagacttccccggccaggaccagagagccgtggccggcgtgttcgacatgtggggccagggcaccatggtgaccgtgagcagc

SEQ ID NO: 32742 - RNA, 432 nt, synthetic construct
  misc_feature 1..432: note = derived and/or modified sequence opt4 from anti-HIV_cap256-048-070061_VR-Chain
  source 1..432: mol_type = other RNA
gaggtgcagctgctggagagcggcggcggcctggtgcagcccggcggcagcctgagactgagctgcgccgccagcggcttcaccttcagcagctacgccatgcactgggtgagacaggcccccggcaagggcctggagtgggtggccgtgaccagctacgacggcagcaacaagtactacgccgacagcgtgaagggcagattcaccatcagcagagacaacagcaagaacaccctgtacatgcagatgaacagcctgagagccgaggacaccgccgtgtactactgcgccaaggaccagggcgagagcgagaaggaggagtgggccagcgactactacgacttcggcagagactaccccggcagagaccccagaagagtggtggccaccttcgccatctggggccagggcaccatggtgaccgtgagcagc

SEQ ID NO: 32743 - RNA, 432 nt, synthetic construct
  misc_feature 1..432: note = derived and/or modified sequence opt4 from anti-HIV_cap256-048-069669_VR-Chain
  source 1..432: mol_type = other RNA
caggtgcagctggtggagagcggcggcggcgtggtgcagcccggcagaagcctgagactgagctgcgccgtgagcggcttcaccttcagcaagttccccatgcactgggtgagacaggcccccggcaagggcctggagtgggtggccgtgatcagctacgacggcaacaagaagtactacgtggacagcgccaagggcagattcaccatcagcagagacaacagcagaaagaccctgtacctgcagatgaccggcctgagacccgaggacaccgccgtgtactactgcgccaaggacctgggcggcggcgagtgcgagacctgggccagcgactactacgacttcggcaaggactacccctgcctggaccccagagacgtggtgggcaccttcgacatctggggccagggcaccctggtgaccgtgagcagc

SEQ ID NO: 32744 - RNA, 432 nt, synthetic construct
  misc_feature 1..432: note = derived and/or modified sequence opt4 from anti-HIV_cap256-048-069205_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggtggtgatcagcaacgacggcaacaacaagtactacgccgacagcgtgaagggcagattcaccatcagcagagacaacagcaagaacaccgtgtacctgcagatgaacagcctgagagccgaggacaccgccgtgtactactgcgccaaggacgtgggcgacaccaagaaggacgagtgggccaccgactactacgacctgagcatcgcctaccccgtgcaggacccccaggccgtggtgggcgccttcgacatctggggccagggcaccatggtgaccgtgagcagc

SEQ ID NO: 32745 - RNA, 432 nt, synthetic construct
  misc_feature 1..432: note = derived and/or modified sequence opt4 from anti-HIV_cap256-048-068882_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccctgatcagctacgacggcaccgacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcaccgcctaccccgtggagcaccccagagccgtggtgggcgtgttcgacatctggggccagggcaccaaggtgaccgtgagcagc

SEQ ID NO: 32746 - RNA, 432 nt, synthetic construct
  misc_feature 1..432: note = derived and/or modified sequence opt4 from anti-HIV_cap256-048-067764_VR-Chain
  source 1..432: mol_type = other RNA
gaggtgcagctggtgcagagcggcggcggcctggtgaagcccggcggcagcctgagactgagctgcgccgccagcggcttcaccttcagcacctacagcatgaactgggtgagacaggcccccggcaagggcctggagtgggtggccgtgatcagcagcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32747 - RNA, 432 nt, synthetic construct
  misc_feature 1..432: note = derived and/or modified sequence opt4 from anti-HIV_cap256-048-066845_VR-Chain
  source 1..432: mol_type = other RNA
caggtgctgctggtggagagcggcggcggcgtggtgcagcccggcggcagcctgaccctgagctgcgccgccagcggcttcaccttcagcaactacggcatgcactgggtgagacaggcccccggcaagggcctggagtgggtggccttcatcagatacgacggcaacaacaagtactacgccgacagcgtgaagggcagattcaccatcagcagagacaacagcaaggacaccctgtacctgcagatggacggcctgagacccgaggacaccgccctgtactactgcgccaaggacctgggcgagagagagtgcgaggagtgggccagcaactactacgacttcggcagagactacccctgccaggaccccagaggcgtggtgggcaccttcgacatctggggccagggcaccatggtgaccgtgagcagc

SEQ ID NO: 32748 - RNA, 432 nt, synthetic construct
  misc_feature 1..432: note = derived and/or modified sequence opt4 from anti-HIV_cap256-048-065226_VR-Chain
  source 1..432: mol_type = other RNA
gaggtgcagctggtggagagcggcggcggcctggtgaagcccggcggcagcctgagactgagctgcgtggccagcggcttcaccttcagcaactacggcatgcactgggtgagacaggcccccggcaagggcctggtgtgggtggccggcatcagcttcgccggcaccaacaagtactacgccgccagcgtgaagggcagattcaccatcagcagagacaacagcaagaacaccctgtacctgcagatgaacagcctgagagccgaggacaccgccctgtactactgcgccaaggacatgagagagtacgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32749 - RNA, 432 nt, synthetic construct
  misc_feature 1..432: note = derived and/or modified sequence opt4 from anti-HIV_cap256-048-063717_VR-Chain
  source 1..432: mol_type = other RNA
caggtgcagctggtggagagcggcggcggcgtggtgcagcccggcagaagcctgagactgagctgcgccgccagcggcttcagcttcagcaaccacgccatggactgggtgagacaggcccccggcaagggcctggagtgggtggccgtgatcagcagcgacggcagcgacaagatctacgccgagagcgtgaagggcagattcaccatcagcagagacaacagcaagaacaccctgtacctgcagatgaacagcctgagagtggaggacaccgccgtgtacttctgcgccaaggacctgggcgccaacaaggacgacgagtgggccaccgactactacgacctgagcatcgcctaccccgtgcccgaccccagagccgtggtgggcgccttcgacatctggggccagggcaccatggtgagcgtgagcagc

SEQ ID NO: 32750 - RNA, 432 nt, synthetic construct
  misc_feature 1..432: note = derived and/or modified sequence opt4 from anti-HIV_cap256-048-063150_VR-Chain
  source 1..432: mol_type = other RNA
gaggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggcccacatcagatacgacggcagcaacaagtactacatcgacagcgtgcagggcagattcaccatcagcagagacaaccccaagaacaccctgtacctgcagatgaacagcctgagaaccgaggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32751 - RNA, 432 nt, synthetic construct
  misc_feature 1..432: note = derived and/or modified sequence opt4 from anti-HIV_cap256-048-062431_VR-Chain
  source 1..432: mol_type = other RNA
caggtgcagctggtggagagcggcggcggcgtggtgcagcccggcagaagcctgagactgagctgcgccgccagcggcttcaccttcagcaacttcgccatggactgggtgagacaggcccccggcaagggcctggagtgggtggccgtgatcagcagcgacggcagcaagaagaactacggcgacagcgtgaagggcagattcaccatcagcagagacaacagcaagaacaccctgttcctgcagatgaacagcctgagacccgaggacaccgccctgtactactgcgccaaggacctgggcggctacaagagcgacgagtgggccaccgactactacgacctgagcatcgcctaccccgtgcaggaccccagaccctggctggagctgctgtacatctggggccagggcgccatggtgaccgtgagcagc

SEQ ID NO: 32752 - RNA, 432 nt, synthetic construct
  misc_feature 1..432: note = derived and/or modified sequence opt4 from anti-HIV_cap256-048-060745_VR-Chain
  source 1..432: mol_type = other RNA
caggtgcagctggtggagagcggcggcagcgtggtgcagcccggcagaagcctgagactgacctgcaccgccagcggcttcaccttcagccactacgccatggactgggtgagacaggcccccggcaagggcctggagtgggtggccgtgatcagcagcgacgccaccaacaagaactacgccgacagcgtgaagggcagattcaccatcagcagagacaacagcaagaacaccgtgtacctgcagatggacagcctgagagccgaggacaccgccgtgtactactgcgccaaggacgtgggcgactacaaggacgacgagtgggccaccgactactacgacttcagcatcgcctaccccgtgcccgaccccagagccgtggtgggcgccttcgacttctggggccagggcaccatggtgaccgtgagcagc

SEQ ID NO: 32753 - RNA, 432 nt, synthetic construct
  misc_feature 1..432: note = derived and/or modified sequence opt4 from anti-HIV_cap256-048-060420_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatggcctgggtgagacaggcccccggcaagggcctggagtgggtgaccgtgatcagcttcgccggcgtgaagaagtactacgccgacagcgtgaagggcagattcaccatcagcagagacaacagcaagggcaccctgtacctgcagatgaacagcctgagagccgaggacaccgccgtgtactactgcgccaaggacgtgggcgacaccaagaaggacgagtgggccaccgactactacgacctgagcatcgcctaccccgtgcaggacccccaggccgtggtgggcgccttcgacatctggggccagggcaccatggtgaccgtgagcagc

SEQ ID NO: 32754 - RNA, 435 nt, synthetic construct
  misc_feature 1..435: note = derived and/or modified sequence opt4 from anti-HIV_cap256-048-060014_VR-Chain
  source 1..435: mol_type = other RNA
caggtgcagctggtggagagcggcggcggcgtggtgcagcccggcagaagcctgagactgagctgcgccgccagcggcttcaccttcagcaactacggcatgcactgggtgagacaggcccccggcaagggcctggagtgggtggccctgatcagccacgacggcagcaacaagaacttcgccgacagcgtgaagggcagattcaccatcagcagagacaacagcaagaacaccctgtacctgcagatgaacagcctgagaaccgaggacaccgccatctactactgcgccaaggacctgggcggcgagagcgagatcgaggagtggcccagcgactactacgacttcggcagagactaccccgtgcccgaccccagaggcgtggtgggcaccttcgacttctggggccagggcaccatggtgaccgtgagcagc

SEQ ID NO: 32755 - RNA, 432 nt, synthetic construct
  misc_feature 1..432: note = derived and/or modified sequence opt4 from anti-HIV_cap256-048-059747_VR-Chain
  source 1..432: mol_type = other RNA
caggtgcagctggtggagagcggcggcggcgtggtgcagcccggcagaagcctgagactgagctgcgccgccagcggcttcaccttcacccactacgccatggactgggtgagacaggcccccggcaagggcctggagtgggtggccgtgatcagcagcgacggcagcagcaaggactacgccgacagcgtgaagggcagattcaccatcagcagagacaacagcaagaacaccctgagcctgcagatgaacagcctgagacccgaggacaccgccgtgtactactgcgccaaggacctgggcgccagcaaggacgacgagtgggccaccgactactacgacctgagcatcgcctaccccgtgcacgaccccagagccgtggtgggcggcttcgacatctggggccagggcaccatggtgaccgtgagcagc

SEQ ID NO: 32756 - RNA, 432 nt, synthetic construct
  misc_feature 1..432: note = derived and/or modified sequence opt4 from anti-HIV_cap256-048-058393_VR-Chain
  source 1..432: mol_type = other RNA
caggtgcagctggtggagagcggcggcggcgtggtgcagcccggcggcagcctgagactgagctgcgccgccagcggcttcaccttcaacacctacggcatgcactgggtgagacaggcccccggcaagggcctggagtgggtgaccttcatcagatacgacggcagcaacgagtactacgccgacagcgtgaagggcagattcaccatcagcagagacaacagcaagaacaccctgtacctgcagatgaacagcctgagcgtggaggacaccgccgtgtactactgcgccaaggacctgggcaagaacaaggacgacgagtgggccaccgactactacgacatcagcatcgcctaccccgtgcccgaccccagagccgtggtgggcgtgttcgacatctggggccagggcaccgtggtgaccgtgagcagc

SEQ ID NO: 32757 - RNA, 432 nt, synthetic construct
  misc_feature 1..432: note = derived and/or modified sequence opt4 from anti-HIV_cap256-048-058159_VR-Chain
  source 1..432: mol_type = other RNA
caggtgcagctggtggagagcggcggcggcgtggtgcagcccggcagaagcctgagactgagctgcgccgccagcggcttcaccttcagcagctaccccatgcactgggtgagacaggcccccggcaagggcctggagtgggtggccgtgatcagcttcgccggcaccaacaagtactacgcccacagcgtgaagggcagattcaccatcagcagagacaacagcaagaacaccctgtacctgcagatgaacagcctgagagccgaggacaccgccctgtactactgcgccagagacctgagagagagcgagtgcgaggagtgggccagcgactactacgacttcggcagagagtacccctgccaggaccccagaggcgtggtgggcaccttcgacatctggggcagaggcaccatggtgaccgtgagcagc

SEQ ID NO: 32758 - RNA, 432 nt, synthetic construct
  misc_feature 1..432: note = derived and/or modified sequence opt4 from anti-HIV_cap256-048-057127_VR-Chain
  source 1..432: mol_type = other RNA
gacgtgtacctggtggagagcggcggcggcctggtgcagcccggcggcagcctgagactgagctgcgtggccagcggcatcaccttcagcagctacggcatgcactgggtgagacaggcccccggcaagggcctggagtgggccgccttcatcagatacgacggcagaaacaagtactacgccgacagcgtgaagggcagattcaccatcagcagagacaacagcaagaacaccctgagcctgcagatgaacaacctgagagccgaggacaccgccgtgtactactgcgccaaggaggtgggcgacaacaaggacgacgagtgggccagcgactactacgacctgagcatcgcctaccccgtgcaggaccccagagccgtggtgggcggctacgacatctggggccagggcaccatggtgaccgtgagcagc

SEQ ID NO: 32759 - RNA, 432 nt, synthetic construct
  misc_feature 1..432: note = derived and/or modified sequence opt4 from anti-HIV_cap256-048-056251_VR-Chain
  source 1..432: mol_type = other RNA
gaggtgcagctggtggagagcggcggcggcctggtgcagcccggcagaagcctgagactgagctgcgccggcagcggcttcaccttcagcaacttcggcttccactgggtgagacaggcccccggcaagggcctggagtgggtggccgccatcagcttcgccggctacaacaagtactacgccgacagcgtgaagggcagattcaccatcagcagagagaacagcaacaacatgctgtacctgcagatgagcagcctgagagccgaggacaccgccgtgtactactgcgccaaggacctgagagagagcgagtgcgaggagtgggccagcgactactacgacttcggcaaggactacccctgccaggaccccagaggcgtggtgggcaccttcgacgtgtggggccacggcagcctggtgaccgtgagcagc

SEQ ID NO: 32760 - RNA, 432 nt, synthetic construct
  misc_feature 1..432: note = derived and/or modified sequence opt4 from anti-HIV_cap256-048-055421_VR-Chain
  source 1..432: mol_type = other RNA
caggtgcagctggtggagagcggcggcggcgtggtgcagcccgccagaagcctgagactgagctgcgccgccagcggcttcatcttcagcacctacggcatgcactgggtgagacaggcccccggcaagggcctggagtgggtggccgtgatcagcagcgacggcagcagcaaggactacgccgacagcgtgaagggcagattcaccatcagcagagacaacagcaagaacaccctgagcctgcagatgaacagcctgagacccgaggacaccgccgtgtactactgcgccaaggacctgggcgccagcaaggacgacgagtgggccaccgactactacgacttcagcatcgcctaccccgtgcaggaccccagagccgtggtgggcgccttcgacatctggggccagggcaccatggtgaccgtgagcagc

SEQ ID NO: 32761 - RNA, 432 nt, synthetic construct
  misc_feature 1..432: note = derived and/or modified sequence opt4 from anti-HIV_cap256-048-054989_VR-Chain
  source 1..432: mol_type = other RNA
caggtgcagctggtggagagcggcggcggcgtggtgcagcccggcggcagcctgagactgagctgcgccgccagcggcttcaccttcagcaccaacggcatgcactgggtgagacaggcccccggcaagggcctggagtgggtggccttcatcagatacgacggcagcaacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32762 - RNA, 435 nt, synthetic construct
  misc_feature 1..435: note = derived and/or modified sequence opt4 from anti-HIV_cap256-048-054759_VR-Chain
  source 1..435: mol_type = other RNA
caggtgcagctggtggagagcggcggcggcgtggtgcagcccggcagaagcctgagactgagctgcgccgccagcggcttcagcttcagcaagaacggcatgcactgggtgagacaggcccccggcaagggcctggagtgggtggccttcgtggccttcgacgagagcgacaagtactacgccgacagcgtgaagggcagattcaccatcagcagagacaacagcaagaacaccctgagcctgcagatgaacagcctgagagtggaggacaccgccgtgtactactgcgccaaggaggtgggcgagaacaaggacgacgagtgggccgcccccgactactacgacttcagcatcgcctaccccgtgcaggaccccagagccgtggtgggcggcttcgacatctggggccagggcaccatggtgaccgtgagcagc

SEQ ID NO: 32763 - RNA, 432 nt, synthetic construct
  misc_feature 1..432: note = derived and/or modified sequence opt4 from anti-HIV_cap256-048-052573_VR-Chain
  source 1..432: mol_type = other RNA
caggtgaagctggtggagagcggcggcggcgtggtgcagcccggcagaagcctgagactgagctgcgccgccagcggcttcagcttcagcaactacgccatggactgggtgagacaggcccccggcaagggcctggagtgggtggccgtggtgagcagcgacggcagcaacaagaactacgccgacagcgtgaagggcagattcaccatcagcagagacaacagcaagaacaccgtgtacctgcagatgaacagcctgagagccgaggacaccgccgtgtactactgcgccaaggacctgggcgccaacaaggacgacgagtgggccaccgactactacgactggagcatcgcctaccccgtgcacgaccccagagccgtggtgggcgtgttcgacatctggggccagggcaccctggtgaccgtgagcagc

SEQ ID NO: 32764 - RNA, 432 nt, synthetic construct
  misc_feature 1..432: note = derived and/or modified sequence opt4 from anti-HIV_cap256-048-051477_VR-Chain
  source 1..432: mol_type = other RNA
caggagcagctggtggagagcggcggcggcgtggtgcagcccggcagaagcctgagactgagctgcgccgccagcggcttcaccttcagcaactacgccatgcactgggtgagacaggcccccggcaagggcctggagtgggtggccgccatgagccacgacggcagcgacaagtactacgccgacagcgtgaagggcagattcaccatcagcagagacaacagcaagaacaccctgtacatgcagatgaacagcctgagagccgaggacaccgccgtgtactactgcgccaaggaccagggcgagagcgagaaggaggagtgggccagcgactactacgacctgagcatcgcctaccccatccaggaccccagagccatggtgggcgccttcgacatctggggccagggcaccatggtgaccgtgagcagc

SEQ ID NO: 32765 - RNA, 432 nt, synthetic construct
  misc_feature 1..432: note = derived and/or modified sequence opt4 from anti-HIV_cap256-048-051299_VR-Chain
  source 1..432: mol_type = other RNA
caggtgcagctggtggagagcggcggcggcgtggtgcagcccggcagaagcctgagactgagctgcgccgccagcggcttcaccttcagcaccttcggcatgcactgggtgagacaggcccccggcaagggcctggagtgggtggccctgatcagccacgacggcaacaacaagtactacgccgacagcctgaagggcagattcaccatcagcagagagaacagcaagaacaccctgttcctgcagatgaacagcctgagagccgaggacaccagcgtgtactactgcgccaaggacctgggcgacagcgagtgcgaggagtgggccagcgactactacgacttcggcaaggactacccctgcctgcaccccagaggcgtggtgggcaccttcgacttctggggccacggcaccatggtgaccgtgagcagc

SEQ ID NO: 32766 - RNA, 432 nt, synthetic construct
  misc_feature 1..432: note = derived and/or modified sequence opt4 from anti-HIV_cap256-048-050815_VR-Chain
  source 1..432: mol_type = other RNA
caggtgcagctggtggagagcggcggcggcgtggtgcagcccggcggcagcctgagactgagctgcgtggtgagcggcttcaccttcagcagctacggcatgcactgggtgagacaggcccccggcaagggcctggagtgggtgagcttcatcagattcgacggcaactacgagtactacgtggacagcgtgaagggcagattcaccatcagcagagacaacagcaagaacaccgtgtacctgcagatggacagcctgagagccgaggacaccgccgtgtactactgcgccaaggacgtgggcgactacaaggacgacgagtgggccaccgactactacgacttcagcatcgcctaccccgtgcccgaccccagagccgtggtgggcgccttcgacttctggggccagggcaccatggtgaccgtgagcagc

SEQ ID NO: 32767 - RNA, 432 nt, synthetic construct
  misc_feature 1..432: note = derived and/or modified sequence opt4 from anti-HIV_cap256-048-049884_VR-Chain
  source 1..432: mol_type = other RNA
caggtgcagctggtggagagcggcggcggcgtggtgcagcccggcagaagcctgagactgagctgcgccgccagcggcttcagcttcaacacctacgccatgcactgggtgagacaggcccccggcaagggcctggagtggatggccctgatcagctacgacggcagcaacaagtactacgtggacagcgtgaagggcagattcaccatcagcagagacaacagcaagaacaccctgtacctgcagatgaacagcctgagagccgaggacaccgccgtgtactactgcgccaaggacctgggcggcaacaaggacgacgagtgggccaccgactactacgacctgagcatcgcctaccccgtgcaggaccccagagtggtggtgggcatcttcgacatctggggccagggcaccatggtgaccgtgagcagc

SEQ ID NO: 32768 - RNA, 432 nt, synthetic construct
  misc_feature 1..432: note = derived and/or modified sequence opt4 from anti-HIV_cap256-048-049170_VR-Chain
  source 1..432: mol_type = other RNA
caggtgcagctggtggagagcggcggcggcgtggtgcagcccggcagaagcctgagactgagctgcgccgccagcggcttcatcttcagcagctacggcatgcactgggtgagacaggcccccggcaagggcctggagtgggtggccgtgatcagcggcgacggcaccaagaaggacttcgccgacagcgtgaagggcagattcaccatcagcaaggacaacagcaagaacatggtgagcctgcagatgaacagcctgagagccgaggacgccgccgtgtactactgcgccaaggacctgggcgagagcgacaacgaggagtggcccagcgactactacgacttcggcagagacttcaccggccagaaccccagagccgtggtgggcaccttcgacctgtggggccagggcaccatggtgaccgtgagcagc

SEQ ID NO: 32769 - RNA, 435 nt, synthetic construct
  misc_feature 1..435: note = derived and/or modified sequence opt4 from anti-HIV_cap256-048-048531_VR-Chain
  source 1..435: mol_type = other RNA
caggtgcagctggtggagagcggcggcggcgtggtgcagcccggcagaagcctgagactgagctgcgccgccagcggcttcaccttcagcagctacggcctgcactgggtgagacaggcccccggcaagggcctggagtgggtggccttcatcagctacgacggcaacaacaagcactacgtggacagcgtgaagggcagattcaccatcagcagagacaacagcaagaacaccctgtacctgcagatgaacagcctgagagccgaggacaccgccgtgtactactgcgccaaggacctgggcggcgagagcgagatcgaggagtgggccaccgactactacgacttcagcatcgcctaccccgtgaaggagagcagaggcgtggtgggcatcttcgacatgtggggccagggcaccatggtgaccgtgagcagc

SEQ ID NO: 32770 - RNA, 432 nt, synthetic construct
  misc_feature 1..432: note = derived and/or modified sequence opt4 from anti-HIV_cap256-048-048259_VR-Chain
  source 1..432: mol_type = other RNA
caggtgcagctggtggagagcggcggcggcgtggtgcagcccggcagaagcctgagactgagctgcgccgccagcggcttcaccttcagcacctgcgccatgcactgggtgagacaggcccccggcaagggcctggagtgggtggccgtgatcagctacgacggcagcaacaagtactacgtggacagcgtgaagggcagattcaccatcagcagagacaacagcaagaacaccctgtacctgcagatgaacagcctgagagccgaggacaccgccgtgtactactgcgccaaggaggtggacatcaacaaggaggacgagtgggccagcgactactacgacttcagcatcgcctaccccgtgcaggaccccagagccgtggtgggcggcttcgacatctggggccagggcaccatggtgaccgtgagcagc

SEQ ID NO: 32771 - RNA, 432 nt, synthetic construct
  misc_feature 1..432: note = derived and/or modified sequence opt4 from anti-HIV_cap256-048-047313_VR-Chain
  source 1..432: mol_type = other RNA
caggtgcagctggtggagagcggcggcggcgtggtgcagcccggcagaagcctgagactgagctgcgccgccagcggcttcaccttcagcaccttcggcatgcactgggtgagacaggcccccggcaagggcctggagtgggtggccgtgatcagccacgacggcaacaacaagtactacgccgacagcgtgaagggcagattcaccatcagcagagacaacagcaagaacaccgtgtacctgcagatgaacagcctgagagccgaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32772 - RNA, 432 nt, synthetic construct
  misc_feature 1..432: note = derived and/or modified sequence opt4 from anti-HIV_cap256-048-046596_VR-Chain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatgagattcgacggcagcaacagatactacggcgacagcgtgaagggcagattcaccatcagcagagacaacagcaagaacaccctgtacctgcagatgaacagcctgagaaccgaggacgccgccctgtactactgcgccaaggacatgagagagttcgagtgcgaggagtgggccagcgactactacgacttcggcagagactacccctgccaggaccccagaggcgtggtgggcatcttcgacatctggggccagggcaccatggtgaccgtgagcagc

SEQ ID NO: 32773 - RNA, 432 nt, synthetic construct
  misc_feature 1..432: note = derived and/or modified sequence opt4 from anti-HIV_cap256-048-044781_VR-Chain
  source 1..432: mol_type = other RNA
caggtgcagctggtggagagcggcggcggcgtggtgcagcccggcagaagcctgagactgagctgcgccgccagcggcttcaccttcaccagctacgccatccactgggtgagacaggcccccggcaagggcctggagtgggtggccgtgatcagctacgacggcagcaagaagaactacgccgacagcgtgaagggcagattcaccatcagcagagacaacagcaagaacaccctgtacgtgcagatgaacagcctgagagccgaggacaccgccgtgtactactgcgccaaggaggtgggcgaggacaaggacgacgagtgggccagcgactactacgacctgagcatcgcctaccccgtgcacgaccccagagccgtggtgggcggcttcgacatctggggccagggcaccatggtgaccgtgagcagc

SEQ ID NO: 32774 - RNA, 432 nt, synthetic construct
  misc_feature 1..432: note = derived and/or modified sequence opt4 from anti-HIV_cap256-048-042599_VR-Chain
  source 1..432: mol_type = other RNA
caggtgcagctggtggagagcggcggcggcgtggtgcagcccggcagaagcctgagactgagctgcgccgccagcggcttcaccttcagcaactacggcatgcactgggtgagacagacccccggcaagggcctggagtgggtggccgtgatcagctacgacggcagcaacaagttctacgccgacagcgtgaagggcagattcaccatcagcagagacaacagcaagaacaccctgtacctgcagatgagcagcctgagagccgacgacaccgccgtgtactactgcgccaaggaggtgggcgaggacaaggacgacgagtgggccagcgactactacgacctgagcatcgcctaccccgtgcacgaccccagagccgtggtgggcggcttcgacatctggggccagggcaccatggtgaccgtgagcagc

SEQ ID NO: 32775 - RNA, 432 nt, synthetic construct
  misc_feature 1..432: note = derived and/or modified sequence opt4 from anti-HIV_cap256-048-041276_VR-Chain
  source 1..432: mol_type = other RNA
caggtgcagctggtggagagcggcggcggcgtggtgcagcccggcagaagcctgagactgagctgcgccgccagcagattcaccttcagcagctacgccatgcactgggtgagacaggcccccggcaagggcctggagtgggtggccatcatcagctacgacggcagcaacaagtactacgccgacagcgtgaagggcagattcaccatcagcagagacaacagcaagaacaccctgttcctgcagatgaacagcctgagagccgaggacaccgccctgtactactgcgccaaggacctgggcggctacaagagcgacgagtgggccaccgactactacgacctgagcatcgcctaccccatccaggaccccagagccgtggtgggcgccttcgacatctggggccagggcaccatggtgaccgtgagcagc

SEQ ID NO: 32776 - RNA, 432 nt, synthetic construct
  misc_feature 1..432: note = derived and/or modified sequence opt4 from anti-HIV_cap256-048-040200_VR-Chain
  source 1..432: mol_type = other RNA
caggtgcagctggtggagagcggcggcggcgtggtgcagcccggcagaagcctgagactgagctgcgtggccagcggcttcaccttcagcagcttcggcatgcactgggtgagacaggcccccggcaagggcctggagtgggtggccgtgatcagccacgacggccacaacaagtactacgccgacagcctgaagggcagattcaccgtgagcagagagaacagcaagaacaccctgttcctgcagatgaacagcctgagagccgaggacaccagcgtgtactactgcgccaaggacctgggcggcggcgagtgcgaggagtgggccagcgactactacgacttcggcagagactacccctgcctgacccccagaggcgtggtgggcaccttcgacatctggggccacggcaccaccgtgaccgtgagcagc

SEQ ID NO: 32777 - RNA, 432 nt, synthetic construct
  misc_feature 1..432: note = derived and/or modified sequence opt4 from anti-HIV_cap256-048-039061_VR-Chain
  source 1..432: mol_type = other RNA
gaggtgcagctgctgggcagcggcggcggcctggtgcagcccggcggcagcctgagactgacctgcgccgtgagcggcttcaccttcagcagcttcgccatgagctgggtgagacaggcccccggcaagggcctggagtgggtggccctgatcagctacgacggcaccgacaagtactacgccgacagcgtgaagggcagattcaccatcagcagagacaacagcaagaacaccctgtacctgcagatgaacagcctgagagtggaggacaccgccatctaccactgcgccaaggacctgggcggcaccaagagcgacgagtgggccaccgactactacgacctgagcatcgcctaccccatccaggaccccggcgccgtggtgggcgtgttcgacatctggggccagggcaccatggtgaccgtgagcagc

SEQ ID NO: 32778 - RNA, 432 nt, synthetic construct
  misc_feature 1..432: note = derived and/or modified sequence opt4 from anti-HIV_cap256-048-038515_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggtggtgatcagctacgacggcagcaacaagtactacgccgacagcgtgaagggcagattcaccatcagcagagacaacagcaagaacaccctgttcctgcagatgaacagcctgagagccgaggacaccgccctgtactactgcgccaaggacgtgggcgagtacaagagcgacgagtgggccaccgactactacgacctgagcatcgcctaccccatccaggaccccagagccatggtgggcgccttcgacatctggggccagggcaccatggtgaccgtgagcagc

SEQ ID NO: 32779 - RNA, 432 nt, synthetic construct
  misc_feature 1..432: note = derived and/or modified sequence opt4 from anti-HIV_cap256-048-038255_VR-Chain
  source 1..432: mol_type = other RNA
caggtgcagctggtggagagcggcggcggcgtggtgcagcccggcagaagcctgagactgagctgcgccgccagcggcttcaccctgagcagctacgccatgcactgggtgagacaggcccccggcaagggcctggagtgggtggccgtgatcagctacgacggcagcaacaagtactacgccgacagcgtgaagggcagattcaccatcagcagagacaacagcaagaacgccctgtacctgcagatgaacagcctgagagccgaggacaccgccctgtactactgcgccaaggacctgagagagtacgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32780 - RNA, 432 nt, synthetic construct
  misc_feature 1..432: note = derived and/or modified sequence opt4 from anti-HIV_cap256-048-038177_VR-Chain
  source 1..432: mol_type = other RNA
caggtgcagctggtggagagcggcggcggcgtggtgcagcccggcagaagcctgagactgagctgcgccgccagcggcttcaccttcaacacctacggcatccactgggtgagacaggcccccggcaagggcctggagtgggtggccctgatcagctacgacggcaccgacaagtactacgccgacagcgtgaagggcagattcaccatcagcagagacaacagcaagaacaccctgtacctgcagatgaacagcctgagagtggaggacaccgccatctaccactgcgccaaggacctgggcggcaccaagagcgacgagtgggccaccgactactacgacctgagcatcgcctaccccatccaggaccccggcgccgtggtgggcgtgttcgacatctggggccagggcaccatggtgaccgtgagcagc

SEQ ID NO: 32781 - RNA, 432 nt, synthetic construct
  misc_feature 1..432: note = derived and/or modified sequence opt4 from anti-HIV_cap256-048-035513_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatggcctgggtgagacaggcccccggcaagggcctggagtgggtgaccgtgatcagcttcgccggcgtgaagaagtactacgccgacagcgtgaagggcagattcaccatcagcagagacaacagcaagggcaccctgtacctgcagatggacggcctgagacccgaggacaccgccctgtactactgcgccaaggacctgggcgagagagagtgcgaggagtgggccagcgactactacgacttcggcagagacttcccctgccaggaccccagaggcgtggtgggcaccttcgacatctggggccagggcaccatggtgaccgtgagcagc

SEQ ID NO: 32782 - RNA, 432 nt, synthetic construct
  misc_feature 1..432: note = derived and/or modified sequence opt4 from anti-HIV_cap256-048-034112_VR-Chain
  source 1..432: mol_type = other RNA
cagatgcagctggtggagagcggcggcggcgtggtgcagcccggcagaagcctgagactgagctgcgccgccagcggcttcaccttcaacagctacgccatgcactgggtgagacaggcccccggcaagggcctggagtgggtggccgtgatcagctacgacggcagcaacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32783 - RNA, 432 nt, synthetic construct
  misc_feature 1..432: note = derived and/or modified sequence opt4 from anti-HIV_cap256-048-033983_VR-Chain
  source 1..432: mol_type = other RNA
caggtgcagctggtggagagcggcggcggcgtggtgcagcccggcgagagcctgagactgagctgcgccgccagcggcttcaccctgagcagccacggcatccactgggtgagacaggcccccggcaagggcctggagtgggtggccttcatcagcagcgacggcagcaacaagaactacggcgacagcgtgaagggcagattcaccatcagcagagacaacagcaagaacaccctgttcctgcagatgaacagcctgagagccgaggacaccgccctgtactactgcgccaaggacgtgggcgagtacaagagcgacgagtgggccaccgactactacgacctgagcatcgcctaccccatccaggaccccagagccatggtgggcgccttcgacatctggggccagggcaccatggtgaccgtgagcagc

SEQ ID NO: 32784 - RNA, 432 nt, synthetic construct
  misc_feature 1..432: note = derived and/or modified sequence opt4 from anti-HIV_cap256-048-032688_VR-Chain
  source 1..432: mol_type = other RNA
caggtgcagctggtggagagcggcggcggcgtggtgcagcccggcagaagcctgagactgagctgcgccgccagcggcttcatcttcaacagctacggcatgcactgggtgagacaggcccccggcaagggcctggagtgggtggccgtggtgcacggcgacggcggcaacaagtactacgccgacagcgtgaagggcagattcaccatcagcagagacaacagcaagaacaccctgtacctggagatgaacagcctgagagccgaggacaccgccgagtactactgcgccaaggacctgggcgagagcgacaaggaggagtggcccagcgactactacgacttcggcagagacttcaccggccaggtgcccagagccgtggtgggcgccttcgacatctggggccagggcaccatggtgaccgtgagcagc

SEQ ID NO: 32785 - RNA, 432 nt, synthetic construct
  misc_feature 1..432: note = derived and/or modified sequence opt4 from anti-HIV_cap256-048-031092_VR-Chain
  source 1..432: mol_type = other RNA
caggtgcagctggtggagagcggcggcggcgtggtgcagcccggcagaagcctgagactgagctgcgccgccagcggcttcagcttctacaacttcgccatggactgggtgagacaggcccccggcaagggcctggagtgggtggccgtgatcagcagcgacggcggcaacaagaactacgtggacagcgtgaagggcagattcaccatcagcagagacaacagcaagaacaccctgtacctgcagatgaacagcctgagagccgaggacaccgccgtgtactactgcgccaaggacctgggcggcaccaaggacgacgagtgggccaccgactactacgacatcagcatcgcctaccccgtgcaggaccccagagccgtggccggcgccttcgacatctggggccagggcaccatggtgaccgtgagcagc

SEQ ID NO: 32786 - RNA, 435 nt, synthetic construct
  misc_feature 1..435: note = derived and/or modified sequence opt4 from anti-HIV_cap256-048-030464_VR-Chain
  source 1..435: mol_type = other RNA
caggtgcagctggtggagagcggcggcggcctggtgaagcccggcggcagcctgagactgagctgcgaggccagcggcttcagcttcaccaactactacatgagctggatcagacaggcccccggcaagggcctggagtgggtggccgtgatcagcttcaacggcagaaacaagtactacgccgacttcgtgaagggcagattcaccatcagcagagacaacagcaagaacaccctgagcctgcagatgaacagcctgagagtggaggacaccgccgtgtactactgcgccaaggaggtgggcgagaacaaggacgacgagtgggccgcccccgactactacgacttcagcatcgcctaccccgtgcaggaccccagagccgtggtgggcggcttcgacatctggggccagggcaccatggtgaccgtgagcagc

SEQ ID NO: 32787 - RNA, 432 nt, synthetic construct
  misc_feature 1..432: note = derived and/or modified sequence opt4 from anti-HIV_cap256-048-030289_VR-Chain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatcagatacgacggcagcaacaagtactacgccgacagcgtgaagggcagattcaccatcagcagagacaacagcaagaacaccgtgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32788 - RNA, 432 nt, synthetic construct
  misc_feature 1..432: note = derived and/or modified sequence opt4 from anti-HIV_cap256-048-030261_VR-Chain
  source 1..432: mol_type = other RNA
caggtgcagctggtggagagcggcggcggcgtggtgcagcccggcggcagcctgagactgagctgcgccgccagcggcttcaccttcagcaccttcggcatgcactgggtgagacaggcccccggcaagggcctggagtgggtggccgtgatcagccacgacggcagcaacaagtactacgccgacagcctgaagggcagattcaccatcagcagagagaacagcaagaacaccctgtacctgcagatgaacagcctgagactggaggacaccgccgtgtaccactgcgccaaggacctgggcggcagcaagagcgacgagtgggccaccgactactacgacctgagcgtggcctaccccgtgcaggaccccagagccgtggtgggcgtgttcgacatctggggccagggcaccatggtgaccgtgagcagc

SEQ ID NO: 32789 - RNA, 432 nt, synthetic construct
  misc_feature 1..432: note = derived and/or modified sequence opt4 from anti-HIV_cap256-048-029362_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccggcatcagcttcgccggcaccaacaagtactacgccgacagcgtgaagggcagattcaccatcagcagagacaacagcaagaacaccctgtacctgcagatgaacagcctgagaaccgaggacgccgccctgtactactgcgccaaggacatgagagagttcgagtgcgaggagtgggccagcgactactacgacttcggcagagactacccctgccaggaccccagaggcgtggtgggcatcttcgacatctggggccagggcaccatggtgaccgtgagcagc

SEQ ID NO: 32790 - RNA, 432 nt, synthetic construct
  misc_feature 1..432: note = derived and/or modified sequence opt4 from anti-HIV_cap256-048-027638_VR-Chain
  source 1..432: mol_type = other RNA
caggtgcagctggtggagagcggcggcggcgtggtgcagcccggcagaagcctgagactgagctgcgtggccagcggcttcatcttcagcagctacggcatccactgggtgagacaggcccccggcaagggcctggagtgggtggccgtgatcagcggcgacggcaccaacaagtactgcgccgacagcgtgaagggcagattcaccatcagcagagacaacagcaagaacaccgtgttcctgcagatgaacagcctgagagccgaggacaccgccgtgttctactgcgccaaggacctgggcgagagcgacaaggaggagtggcccagcgactactacgacttcggcagagacttcaccggccaggtgcccagagccgtggtgggcgccttcgacatctggggccagggcaccatggtgaccgtgagcagc

SEQ ID NO: 32791 - RNA, 432 nt, synthetic construct
  misc_feature 1..432: note = derived and/or modified sequence opt4 from anti-HIV_cap256-048-027613_VR-Chain
  source 1..432: mol_type = other RNA
gtgcagcagctggtggagagcggcggcgacgtggtgcagcccggcaccagcctgagactgagctgcgaggccagcggcctgatcctgagcggctacggcctgcactgggtgagacaggcccccggcaagggcatggagtgggtggccgtgatcagctacgacggcagcaacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcaccgcctaccccgtggagcaccccagagccgtggtgggcgtgttcgacatctggggccagggcaccaaggtgaccgtgagcagc

SEQ ID NO: 32792 - RNA, 432 nt, synthetic construct
  misc_feature 1..432: note = derived and/or modified sequence opt4 from anti-HIV_cap256-048-026627_VR-Chain
  source 1..432: mol_type = other RNA
caggtgcagctgctgggcagcggcggcggcagcgtgcagcccggcggcagcctgagactgacctgcgccgtgagcggcttcaccttcagcagcttcgccatgagctgggtgagacaggcccccggcaagggcctggagtgggtggccttcatcagcagcgacggcaccaacaagaactacggcgacagcgtgaagggcagattcaccatcagcagagacaacagcaagaacaccctgttcctgcagatgaacagcctgagagccgaggacaccgccctgtactactgcgccaaggacctgggcggctacaagagcgacgagtgggccaccgactactacgacctgagcatcgcctaccccatccaggaccccagagccgtggtgggcgccttcgacatctggggccagggcaccatggtgaccgtgagcagc

SEQ ID NO: 32793 - RNA, 432 nt, synthetic construct
  misc_feature 1..432: note = derived and/or modified sequence opt4 from anti-HIV_cap256-048-026239_VR-Chain
  source 1..432: mol_type = other RNA
cagatgcagctggtggagagcggcggcggcgtggtgcagcccggcagaagcctgagactgagctgcgccgccagcggcttcaccttcaacagctacgccatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagaaccgaggacgccgccctgtactactgcgccaaggacatgagagagttcgagtgcgaggagtgggccagcgactactacgacttcggcagagactacccctgccaggaccccagaggcgtggtgggcatcttcgacatctggggccagggcaccatggtgaccgtgagcagc

SEQ ID NO: 32794 - RNA, 432 nt, synthetic construct
  misc_feature 1..432: note = derived and/or modified sequence opt4 from anti-HIV_cap256-048-025518_VR-Chain
  source 1..432: mol_type = other RNA
caggtgcagctggtggagagcggcggcggcgtggtgcagcccggcagaagcctgagactgagctgcgccgtgagcggcttcaccttcagccagcacgccatgcactgggtgagacaggcccccggcaagggcctggagtgggtgaccctgatcagcaacgacggcaccgagaagttctacgccgacagcgtgaagggcagattcaccatcagcagagacaacagcaagaacaccctgtacctgcagatgaacagcctgagcgtggaggacaccgccgtgtactactgcgccaaggacctgggcaagaacaaggacgacgagtgggccaccgactactacgacatcagcatcgcctaccccgtgcccgaccccagagccgtggtgggcgtgttcgacatctggggccagggcaccgtggtgaccgtgagcagc

SEQ ID NO: 32795 - RNA, 432 nt, synthetic construct
  misc_feature 1..432: note = derived and/or modified sequence opt4 from anti-HIV_cap256-048-024854_VR-Chain
  source 1..432: mol_type = other RNA
caggtgcagctggtggagagcggcggcggcgtggtgcagcccggcagaagcctgaccctgagctgcgccgccagcggcttcaccttcaacaactacgacatgcactgggtgagacaggcccccggcaagggcctggagtgggtggccttcaccagatacgacggcagcaaccagtactacgccgacagcgtgaccggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32796 - RNA, 432 nt, synthetic construct
  misc_feature 1..432: note = derived and/or modified sequence opt4 from anti-HIV_cap256-048-024537_VR-Chain
  source 1..432: mol_type = other RNA
caggtgcagctggtggagagcggcggcgccgtggtgcagcccggcagaagcctgagactgagctgcgtggccagcggcttcaccttcagcagctacgccatgcactgggtgagacaggcccccggcaagggcctggactgggtggccctgatcagctacgacggcagcaacaagtacttcgccgacagcgtgaagggcagattcgccatcagcagagacaacagcaagaacaccctgtacctgcagatgaacagcctgagacccgaggacaccgccgtgtactactgcgccaaggacctgggcggcggcgagtgcgagacctgggccagcgactactacgacttcggcaaggactacccctgcctggaccccagagacgtggtgggcaccttcgacatctgggtgcagggcaccctggtgaccgtgagcagc

SEQ ID NO: 32797 - RNA, 432 nt, synthetic construct
  misc_feature 1..432: note = derived and/or modified sequence opt4 from anti-HIV_cap256-048-021781_VR-Chain
  source 1..432: mol_type = other RNA
caggtgcacctggtggagagcggcggcggcctggtgaagcccggcggcagcctgagactgagctgcgaggccagcggcttcagcttcagcaactacgccatggactgggtgagacaggcccccggcaagggcctggagtgggtggccttcgtgagcagcgacggcagcaacaagaactacgccgacagcgtgaagggcagattcaccatcagcagagacaacagcaagaacaccgtgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32798 - RNA, 432 nt, synthetic construct
  misc_feature 1..432: note = derived and/or modified sequence opt4 from anti-HIV_cap256-048-021758_VR-Chain
  source 1..432: mol_type = other RNA
caggtgcagctggtggagagcggcggcggcgtggtgcagcccggcagaagcctgagactgagctgcgccgccagcggcttcaccttcagcagatacggcatgcactgggtgagacaggcccccggcaagggcctggagtgggtggccgtgatcagctacgacggcagcaaggagtactacgccgacagcgtgaagggcagattcaccatcagcagagacaacagcaaggacaccctgtacctgcagatgagcagcctgagagtggaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32799 - RNA, 432 nt, synthetic construct
  misc_feature 1..432: note = derived and/or modified sequence opt4 from anti-HIV_cap256-048-020988_VR-Chain
  source 1..432: mol_type = other RNA
caggtgcagctggtggagagcggcggcggcgtggtgcagcccggcagaagcctgagactgagctgcgaggccagcgccttcaccttcagcagctacggcatgcactgggtgagacaggcccccggcaagggcctggagtgggtgaccttcatcagctacagcggcaacaacaagtactacgccgacagcgtgaagggcagattcaccgtgagcagagacaacagcaagaacaccctgtacctgcagatgaacagcctgaccagcgaggacaccgccgtgtactactgcgccaaggacctgggcggcagcaagaccgacgagtggggcaccgactactacgagttctggaacgcctaccccgtgcaggaccccagagtggtggtgggcgccttcgacatctggggccacggcaccatggtgaccgtgagcagc

SEQ ID NO: 32800 - RNA, 435 nt, synthetic construct
  misc_feature 1..435: note = derived and/or modified sequence opt4 from anti-HIV_cap256-048-020663_VR-Chain
  source 1..435: mol_type = other RNA
caggtgcagctggtggagagcggcggcggcgtggtgcagcccggcatgagcctgagactgagctgcgccgccagcggcttcaccttcagcaacttcggcatgcactgggtgagacaggcccccggcaagggcctggagtgggtggccgtgatcagccacgacggcaacaacaagtactaccccgacagcgtgcagggcagattcaccatcagcagagagaacagcaagaacaccctgtacctgcagatgaacagcctgaagcccgaggacaccgccgtgtacttctgcgccaaggacctgggcggcgagagcgaggtggaggagtgggccagcgactactacgacttcggcagagacatccccggccccgaccccagaggcgtggtgggcaccctggacatctggggccacggcaccatggtgaccgtgagcagc

SEQ ID NO: 32801 - RNA, 432 nt, synthetic construct
  misc_feature 1..432: note = derived and/or modified sequence opt4 from anti-HIV_cap256-048-020590_VR-Chain
  source 1..432: mol_type = other RNA
caggtgcagctggtggagagcggcggcggcgtggtgcagcccggcggcgtgcccagactggcctgcgccgccagcggcttcaccttcagcagctacgccatgcactgggtgagacaggcccccggcaagggcctggagtgggtgaccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcggcaccaaggacgacgagtgggccaccgactactacgacatcagcatcgcctaccccgtgcaggaccccagagccgtggccggcgccttcgacatctggggccagggcaccatggtgaccgtgagcagc

SEQ ID NO: 32802 - RNA, 432 nt, synthetic construct
  misc_feature 1..432: note = derived and/or modified sequence opt4 from anti-HIV_cap256-048-019765_VR-Chain
  source 1..432: mol_type = other RNA
caggtgcagctggtggagagcggcggcggcgtggtgcagcccggcagaagcctgagactgagctgcgccgccagcggcttcatcttcaccaactacgccatggactgggtgagacaggcccccggcaagggcctggagtgggtggccgtgatcagcagcgacggcagcaacaagaactacgccgacagcgtgaagggcagattcaccatcagcagagacaacagcaagaacaccgtgagcctgcagatgaacagcctgagagccgaggacaccgccgtgtactactgcgccaaggacctgggcgacagcaagaaggacgagtgggccaccgactactacgacctgagcatcgcctaccccgtgcccgaccccagagccgtggtgggcgccttcgacatctggggccagggcaccatggtgaccgtgagcagc

SEQ ID NO: 32803 - RNA, 432 nt, synthetic construct
  misc_feature 1..432: note = derived and/or modified sequence opt4 from anti-HIV_cap256-048-019254_VR-Chain
  source 1..432: mol_type = other RNA
caggtgcagctggtggagagcggcggcggcgtggtgcagcccggcagaagcctgagactgagctgcgccgccagcggcttcaccagcagcacctacgccatgcactgggtgagacaggcccccggcaagggcctggagtgggtggccctgatcagctacgacggcaccgacaagtactacgccgacagcgtgaagggcagattcaccatcagcagagacaacagcaagaacaccctgtacctgcagatgaacagcctgagagtggaggacaccgccgtgtaccactgcgccaaggacctgggcggcaacaagcccgacgagtgggccaccgactactacgacctgagcatcgcctaccccgtgcaggaccccagagccgtggtgggcgtgttcgacatctggggccagggcaccatcatcaccgtgagcagc

SEQ ID NO: 32804 - RNA, 432 nt, synthetic construct
  misc_feature 1..432: note = derived and/or modified sequence opt4 from anti-HIV_cap256-048-018073_VR-Chain
  source 1..432: mol_type = other RNA
caggtgcagctggtggagagcggcggcggcgtggtgcagcccggcagaagcctgagactgagctgcgccgccagcggcttcagcctgagcagctacgccatggactgggtgagacaggcccccggcaagggcctggagtgggtggccgtgatcagcagcgacggcaccaacaagtactacgccgacagcgtgaagggcagattcaccatcaccagagacaacagcaagaacaccctgtacctgcagatgaacagcctgagagtggaggacaccgccctgtactactgcgccaaggacatgggcgagagcgagaaggaggagtgggccagcgactactacgacttcggcagagacatccccggccaggaccccagaggcgaggtgggcagcttcgacatctggggccagggcaccatggtgaccgtgagcagc

SEQ ID NO: 32805 - RNA, 432 nt, synthetic construct
  misc_feature 1..432: note = derived and/or modified sequence opt4 from anti-HIV_cap256-048-016775_VR-Chain
  source 1..432: mol_type = other RNA
gaggtgcagctggtggagttcggcggcggcctggtgcagcccggcagaagcctgagactgagctgcgccgccagcgccttcaccttcagccactacggcatccactgggtgagacaggcccccggcaagggcctggagtgggtggccgtgatcagccacgacggcagcaccaaggactacgccgacagcgtgaagggcagattcaccatcagcagagacaacagcaagaacaccatgtacctgcagatgaacagcctgagagccgaggacaccgccgtgtactactgcgccagagacctgggcgagagcgagaccgaggagtgggccaccgactactacgacttcagcatcgcctaccccgtgcagaaccccagaggcgtgatcggcgtgctggacatctggggcctgggcaccatggtgaccgtgagcagc

SEQ ID NO: 32806 - RNA, 432 nt, synthetic construct
  misc_feature 1..432: note = derived and/or modified sequence opt4 from anti-HIV_cap256-048-016069_VR-Chain
  source 1..432: mol_type = other RNA
caggtgcagctggtggagagcggcggcggcgtggtgcagcccggcagaagcctgagactgagctgcgccgccagcggcttcaccttcagcaagtacgccatgcactgggtgagacaggcccccggcaagggcctggagtgggtggccttcgtggccttcgacgagagcgccaagttctacgccgacagcgtgaagggcagattcaccatcagcagagacaacagcaagaacaccctgagcctgcagatgaacagcctgagagccgaggacaccgccgtgtactactgcgccaaggaggtgggcgagaacaaggacgacgagtgggccagcgactactacgacctgagcatcgcctaccccgtgcacgaccccagagccgtggtgggcggcttcgacgtgtggggccagggcaccatggtgaccgtgagcagc

SEQ ID NO: 32807 - RNA, 432 nt, synthetic construct
  misc_feature 1..432: note = derived and/or modified sequence opt4 from anti-HIV_cap256-048-015867_VR-Chain
  source 1..432: mol_type = other RNA
caggtgcagctggtggagagcggcggcggcgtggtgcagcccggcagaagcctgagactgagctgcagcgccagcggcttcagcttcaccaactacgccatggactgggtgagacaggcccccggcaagggcctggagtgggtggccgtgatcagcagcgacggcagcaacaagaactacgccgacagcgtgaagggcagattcaccatcagcagagacaacagcaagaacaccctgttcctgcagatgaacagcctgagacccgaggacaccgccgtgtacttctgcgccaaggacctgggcgccaacaaggacgacgagtgggccaccgactactacgacctgagcatcgcctaccccgtgcacgaccccagagccgtggtgggcatcttcgacctgtggggccagggcaccatggtgaccgtgagcagc

SEQ ID NO: 32808 - RNA, 432 nt, synthetic construct
  misc_feature 1..432: note = derived and/or modified sequence opt4 from anti-HIV_cap256-048-015673_VR-Chain
  source 1..432: mol_type = other RNA
caggtgcacctggtggagagcggcggcggcgtggtgcagcccggcagaagcctgagactgagctgcgccgccagcggcttcaccttcagcaacttcgccatgggctgggtgagacaggcccccggcaagggcctggagtgggtggccttcatcagcagcgacggcaccaacaagaactacggcgacagcgtgaagggcagattcaccatcagcagagacaacagcaagaacaccctgttcctgcagatgaacagcctgagagccgaggacaccgccctgtactactgcgccaaggacctgggcggctacaagagcgacgagtgggccaccgactactacgacctgagcatcgcctaccccatccaggaccccagagccgtggtgggcgccttcgacatctggggccagggcaccatggtgaccgtgagcagc

SEQ ID NO: 32809 - RNA, 432 nt, synthetic construct
  misc_feature 1..432: note = derived and/or modified sequence opt4 from anti-HIV_cap256-048-015156_VR-Chain
  source 1..432: mol_type = other RNA
caggtgcagctggtggagagcggcggcggcgtggtgcagcccggcagaagcctgagactgagctgcgccgccagcggcttcaccttcagcgtgtacgccctgcactgggtgagacagacccccggcaagggcctggagtgggtggccctgatcagctacgacggcaccaacaagtactacgtggacagcgtgaagggcagattcaccatcagcagagacaacagcaagaacaccctgtacctgcagatgaacagcctgaccgccgaggacaccgccgtgtactactgcgccaaggacctgggcggcagcaagaacgacgagtgggccaccgactactacgacctgagcatcgcctaccccatccaggaccccagagccgtggccggcatcttcgacgtgtggggcagaggcaccatggtgaccgtgagcagc

SEQ ID NO: 32810 - RNA, 432 nt, synthetic construct
  misc_feature 1..432: note = derived and/or modified sequence opt4 from anti-HIV_cap256-048-014521_VR-Chain
  source 1..432: mol_type = other RNA
gaggtgcagctggtggagagcggcggcggcctggtgcagcccggcagaagcctgagactgagctgcgccgccagcggcttcatcttcagcagctacggcatccactgggtgagacagggccccggcaagggcctggagtgggtggccctgatcagcggcgacggcaacaacaagtactacgccgacagcgtgcagggcagattcagcatcagcagagacaacagcaagaacaccctgtacctgcagatgaacagcctgagagccgaggacaccgccgtgtactactgcgccaaggacctgggcgagagcgacaaggaggagtggcccagcgactactacgacttcggcagagacttcaccggccaggaccccagagccgtggtgggcgtgttcgacatctggggccagggcaccaccgtgatcgtgagcagc

SEQ ID NO: 32811 - RNA, 432 nt, synthetic construct
  misc_feature 1..432: note = derived and/or modified sequence opt4 from anti-HIV_cap256-048-014475_VR-Chain
  source 1..432: mol_type = other RNA
caggtgcagctggtggagagcggcggcggcgtggtgcagcccggcagaagcctgagactgagctgcgccgccagcggcttcaccttcaacaccttcggcatgcactgggtgagacaggcccccggcaagggcctggagtgggtggccgtgatcagccacgacggcaacaacaagtactacgccgacagcctgaagggcagattcaccatcagcagagagaacagcaagaacaccctgttcctgcagatgaacagcctgagagccgaggacaccagcgtgtactactgcgccaaggacctgggccacggcgagtgcgaggagtgggccagcgactactacgacttcggcaaggactacccctgcctgacccccagaggcgtggccggcaccttcgacatctggggccacggcaccaccgtgaccgtgagcagc

SEQ ID NO: 32812 - RNA, 432 nt, synthetic construct
  misc_feature 1..432: note = derived and/or modified sequence opt4 from anti-HIV_cap256-048-013798_VR-Chain
  source 1..432: mol_type = other RNA
caggtgcagctggtggagagcggcggcggcgtggtgcagcccggcagaagcctgagactgagctgcgccgccagcggcttcaccttcaacaactacggcacccactgggtgagacaggcccccggcaagggcctggagtgggtggccgtgatcagcgacagcggcagcaacaagtactacgccgacagcgtgaagggcagattcaccatcagcagagacaacagcaagaacaccctgtacctgcagatgaacagcctgagagccgaggacaccgccgtgtacttctgcgccaaggacctgggcggcagagagaccgaggagtgggccagcgactactacgacttcggcagagacttccccggccaggaccagagagccgtggccggcgtgttcgacatgtggggccagggcaccatggtgaccgtgagcagc

SEQ ID NO: 32813 - RNA, 432 nt, synthetic construct
  misc_feature 1..432: note = derived and/or modified sequence opt4 from anti-HIV_cap256-048-013271_VR-Chain
  source 1..432: mol_type = other RNA
gaggtgcagctggtggagagcggcggcggcgtggtgagacccggcggcagcctgagactgagctgcgccgccagcggcttcatcttcagcagctacggcatccactgggtgagacaggcccccggcaagggcctggagtgggtggccgtgatcagcggcgacggcaccaacaagtactgcgccgacagcgtgaagggcagattcaccatcagcagagacaacagcaagaacaccctgtacctgcagatcaacagcctgagagtggaggacaccgccgtgtactactgcgccaaggacctgggcaagaacaaggacgacgagtgggccaccgactactacgacctgagcatcgcctaccccgtgcccgaccccagagccgtggtgggcgtgttcgacatctggggccagggcaccgtggtgaccgtgagcagc

SEQ ID NO: 32814 - RNA, 432 nt, synthetic construct
  misc_feature 1..432: note = derived and/or modified sequence opt4 from anti-HIV_cap256-048-013180_VR-Chain
  source 1..432: mol_type = other RNA
caggtgcagctggtggagagcggcggcggcgtggtgcagcccggcagaagcctgagactgagctgcgccgccagcggcttcaccttcagcaagaacggcatgcactgggtgagacaggcccccggcaagggcctggagtgggtggccttcgtggccttcgacggcagcgacaagtactacgccgacagcgtgaagggcagattcgtgatcagcagagacaacagcaagaacaccctgagcctgcagatgaacagcctgagagccgaggacaccgccgtgtactactgcgccaaggaggtgggcgaggacaaggacgacgagtgggccagcgactactacgacctgagcatcgcctaccccgtgcacgaccccagagccgtggtgggcggcttcgacatctggggccagggcaccatggtgaccgtgagcagc

SEQ ID NO: 32815 - RNA, 432 nt, synthetic construct
  misc_feature 1..432: note = derived and/or modified sequence opt4 from anti-HIV_cap256-048-012148_VR-Chain
  source 1..432: mol_type = other RNA
caggtgcagctggtggagagcggcggcggcgtggtgcagcccggcagaagcctgagactgagctgcgccgccagcggcttcaccttcacccactacgccatggactgggtgagacaggcccccggcaagggcctggagtgggtggccgtgatcagcagcgacggcagcagcaagaactacgccgacagcgtgagaggcagattcaccatcagcagagacaacagcaagaacaccctgagcctgctgatgaacggcctgagacccgaggacaccgccgtgtactactgcgccaaggacgtgggcgacgtgaagaacgacgagtgggccaccgactactacgacctgagcatcgcctaccccgtgcaggaccccagagccgtggtgggcgccttcgacttctggggccagggcaccatggtgaccgtgagcgcc

SEQ ID NO: 32816 - RNA, 432 nt, synthetic construct
  misc_feature 1..432: note = derived and/or modified sequence opt4 from anti-HIV_cap256-048-011870_VR-Chain
  source 1..432: mol_type = other RNA
caggtgcagctggtggagagcggcggcggcgtggtgcagcccggcagaagcctgagactgagctgcgccgtgagcggcttcaccttcagcttctacggcatgcactgggtgagacaggcccccggcaagggcctggagtgggtggccgtgatcagctacgacggcaacaacaagtactacgtggacagcgtgaagggcagattcatcatcagcagagacaacagcaagaacaccctgtacctgcagatgaacagcctgagagtggaggacaccgccgtgtactactgcgccagagacctgggcgagagagagaacgaggagtgggccaccgactactacgacttcagcatcgcctaccccatcgagggccccagaggcgtggtgggcgtgttcgacatctggggcagaggcaccatggtgaccgtgagcagc

SEQ ID NO: 32817 - RNA, 432 nt, synthetic construct
  misc_feature 1..432: note = derived and/or modified sequence opt4 from anti-HIV_cap256-048-011530_VR-Chain
  source 1..432: mol_type = other RNA
caggtgcacctggtggagagcggcggcggcgtggtgcagcccggcagaagcctgagactgagctgcgccgccagcggcttcagcttcagaaactacgccatggactgggtgagacaggcccccggcaagggcctggagtgggtggccgtgatcagcagcgacggcagcgacaagcactacgccgacagcgtgagaggcagattcaccatcagcagagacaacagcaagaacaccctgtacctgcagatgaacagcctgagagtggaggacaccgccgtgtactactgcgccaaggacctgggcgccaacaagaacgacgagtgggccaccgactactacgacttcagcatcgcctaccccgtgcccgaccccagagccgtggtgggcgccttcgacatctggggccagggcaccatggtgaccgtgagcagc

SEQ ID NO: 32818 - RNA, 432 nt, synthetic construct
  misc_feature 1..432: note = derived and/or modified sequence opt4 from anti-HIV_cap256-048-010968_VR-Chain
  source 1..432: mol_type = other RNA
caggtgcagctggtggagagcggcggcggcgtggtgcagcccggcagaagcctgagactgagctgcgccgccagcggcttcatcttcagcagctacggcatgcactgggtgagacaggcccccggcaagggcctggagtgggtggccctgatcagcggcgacggcagcaacaagtactacgccgacagcgtgaagggcagattcaccatcagcagagacaacagcaagaacaccctgtacctgcagatgaacagcctgagagccgaggacagcgccctgtacttctgcgccaaggacctgggcgagagcgacaaggaggagtggcccagcgactactacgacttcggcagagacttcaccggccaggtgcccagagccgtggtgggcatcttcgacatgtggggccagggcaccatggtgaccgtgagcagc

SEQ ID NO: 32819 - RNA, 426 nt, synthetic construct
  misc_feature 1..426: note = derived and/or modified sequence opt4 from anti-HIV_cap256-048-010224_VR-Chain
  source 1..426: mol_type = other RNA
gaggtgcacctggtggagagcggcggcgacctggtgcagcccggcggcagcctgagactgagctgcgtggtgagcgagttcaccttcagcagctacggcatgcactgggtgagacaggcccccggcaagggcctggagtgggtggccttcatcagatacgacggcagcaacaagtactacgccgacagcgtgaagggcagattcaccatcagcagagacaacagcaaggtgtacctggagatgaacagcctgagagccgaggacaccgccgtgtactactgcgccaaggaggtgggcgagaacaaggacgacgagtgggccagcgactactacgacctgagcatcgcctaccccatccacgaccccagagccgtggtgggcggcttcgacatctggggccagggcaccatggtgaccgtgagcagc

SEQ ID NO: 32820 - RNA, 432 nt, synthetic construct
  misc_feature 1..432: note = derived and/or modified sequence opt4 from anti-HIV_cap256-048-009749_VR-Chain
  source 1..432: mol_type = other RNA
caggtgcagctggtggagagcggcggcggcgtggtgcagcccggcagaagcctgagactgagctgcggcgccagcggcttcaccttcagcagctacgccatgcactgggtgagacaggcccccggcagaggcctggagtgggtggccttcaccagcagcgacggcagcaacaagaactacggcgacagcgtgaagggcagattcaccatcagcagagacaacagcaagaacaccctgttcctgcagatgaacagcctgagagccgaggacaccgccctgtactactgcgccaaggacgtgggcgagtacaagagcgacgagtgggccaccgactactacgacctgagcatcgcctaccccatccaggaccccagagccatggtgggcgccttcgacatctggggccagggcaccatggtgaccgtgagcagc

SEQ ID NO: 32821 - RNA, 432 nt, synthetic construct
  misc_feature 1..432: note = derived and/or modified sequence opt4 from anti-HIV_cap256-048-009623_VR-Chain
  source 1..432: mol_type = other RNA
caggtgcagctggtggagagcggcggcggcgtggtgcagcccggcagaagcctgagactgagctgcgccgccagcggcttcagcttcagcaagtacggcatgcactgggtgagacaggcccccggcaagggcctggagtgggtggccttcgtggccttcgacgagggcgacaagtactacgtggacagcgtgaagggcagattcaccatcagcagagacaacagcaagaacaccctgagcctgcagatgaacagcctgagagccgaggacaccgccgtgtactactgcgccaaggaggtgggcgagaacaaggacgacgagtgggccagcgactactacgacctgagcatcgcctaccccatccacgaccccagagccgtggtgggcggcttcgacatctggggccagggcaccatggtgaccgtgagcagc

SEQ ID NO: 32822 - RNA, 432 nt, synthetic construct
  misc_feature 1..432: note = derived and/or modified sequence opt4 from anti-HIV_cap256-048-008234_VR-Chain
  source 1..432: mol_type = other RNA
caggtgcagctggtggagagcggcggcggcgtggtgcagcccggcagaagcctgagactgagctgcgccgccagcggcttcaccttcaccaactacgccatggactgggtgagacaggcccccggcaagggcctggagtgggtggccgtgatcagcagcgacggcagcaacaagaactacgccgacagcgtgaagggcagattcaccatcagcagagacaacagcaagaacaccgtgtacctgcagatgagcagcctgagacccgaggacaccgccgtgtactactgcgccaaggacgtgggcgacaccaagagcgacgagtgggccaccgactactacgacctgagcatcgcctaccccgtgcaggaccccagagccgtggtgggcgccttcgacatctggggccagggcaccatggtgaccgtgagcagc

SEQ ID NO: 32823 - RNA, 432 nt, synthetic construct
  misc_feature 1..432: note = derived and/or modified sequence opt4 from anti-HIV_cap256-048-008149_VR-Chain
  source 1..432: mol_type = other RNA
caggtgcagctggtggagagcggcggcggcgtggtgcagcccggcagaagcctgagactgagctgcgccgccagcggcttcaccttcagcgtgtacaccatgcactgggtgagacaggcccccggcaagggcctggagtgggtggccgtgatcagctacgacggcagaaacaagtactacgccgacagcgtgaagggcagattcaccatcagcagagacaacagcaagaacaccgtgtacctgcagatgaacagcctgagagtggaggacaccgccgtgtactactgcgccaaggacctgggcgccaacaaggacgacgagtgggccaccgactactacgacctgagcgtggcctaccccgtgcccgaccccagagccgtggtgggcgccttcgacgtgtggggccagggcaccatggtgaccgtgagcagc

SEQ ID NO: 32824 - RNA, 432 nt, synthetic construct
  misc_feature 1..432: note = derived and/or modified sequence opt4 from anti-HIV_cap256-048-007301_VR-Chain
  source 1..432: mol_type = other RNA
caggtgcagctggtggagagcggcggcggcgtggtgcagcccggcagaagcctgagactgagctgcgccgccagcggcttcagcttcaactactacgccatggactgggtgagacaggcccccggcaagggcctggagtgggtggccgtgatcagcagcgacggcagaaacaagaactacgccgacagcgtgaagggcagattcaccatcagcagagacaacagcaagaacaccctgtacctgcagatgaacagcctgagcgtggaggacaccgccgtgtactactgcgccaaggacctgggcaagaacaaggacgacgagtgggccaccgactactacgacatcagcatcgcctaccccgtgcccgaccccagagccgtggtgggcgtgttcgacatctggggccagggcaccgtggtgaccgtgagcagc

SEQ ID NO: 32825 - RNA, 432 nt, synthetic construct
  misc_feature 1..432: note = derived and/or modified sequence opt4 from anti-HIV_cap256-048-007174_VR-Chain
  source 1..432: mol_type = other RNA
caggtgcagctggtggagagcggcggcggcgtggtgcagcccggcagaagcctgagactgagctgcgccgccagcggcttcaccttcaacagctacggcatggcctgggtgagacaggcccccggcaagggcctggagtgggtggccctgatcagctacgacggcagcaacaagtactacgccgacagcgtgagaggcagattcaccatcagcagagacaacagcaaggacaccctgtacctgcagatggacggcctgagacccgaggacaccgccctgtactactgcgccaaggacctgggcgagagcgagtgcgaggagtgggccagcgactactacgacttcggcagagactacccctgcctggcccccagaggcgtgcccggcaccttcgacatctggggccagggcaccatggtgaccgtgagcagc

SEQ ID NO: 32826 - RNA, 432 nt, synthetic construct
  misc_feature 1..432: note = derived and/or modified sequence opt4 from anti-HIV_cap256-048-007079_VR-Chain
  source 1..432: mol_type = other RNA
caggtgcagctggccgagagcggcggcggcgtggtgcagcccggcagaagcctgagactgagctgcgccgccagcggcttcaccttcagcatctacggcatgcactgggtgagacaggcccccggcaagggcctggagtgggtggccttcatcctgagcgacggcaccgacaagtacagcgccgacagcgtgaagggcagattcaccatcagcagagacaacagcaagaacaccctgtacctgcagatgaacagcctgagagccgaggacaccgccgtgtactactgcgccaaggacctgggcaaggccaaggacgacgagtgggccaccgactactacgacttcagcatcgcctaccccgtgcacgaccccagaggcgtggccggcatcttcgacatctggggccagggcaccatggtgaccgtgagcagc

SEQ ID NO: 32827 - RNA, 432 nt, synthetic construct
  misc_feature 1..432: note = derived and/or modified sequence opt4 from anti-HIV_cap256-048-007033_VR-Chain
  source 1..432: mol_type = other RNA
caggtgcagctggtggagagcggcggcggcgtggtgcagcccggcagaagcctgagactgagctgcgccgccagcggcttcaccttcagcaacttcggcttccactgggtgagacaggcccccggcaagggcctggagtgggtggccgccatcagcttcgccggcaacaacaagtactacgccgacagcgtgaagggcagattcaccatcagcagagagaacagcaagaacatcctgtacctgcagatgaacagcctgagaggcgaggacaccgccgtgtactactgcgccaaggacctgagagagttcgagtgcgaggagtgggccagcgactactacgacttcggcagagactacccctgccaggaccccagaggcgtggtgggcaccttcgacgtgtggggccacggcagcctggtgaccgtgagcagc

SEQ ID NO: 32828 - RNA, 432 nt, synthetic construct
  misc_feature 1..432: note = derived and/or modified sequence opt4 from anti-HIV_cap256-048-006128_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccctgatcagctacgacggcaccgacaagtactacgccgacagcgtgaagggcagattcaccatcagcagagacaacagcaagaacaccctgtacctgcagatgaacagcctgagagtggaggacaccgccgtgtaccactgcgccaaggacctgggcggcagcaagagcgacgagtgggccaccgactactacgactggagcatcgcctaccccgtgcacgaccccagagccgtggtgggcgtgttcgacatctggggccagggcaccctggtgaccgtgagcagc

SEQ ID NO: 32829 - RNA, 432 nt, synthetic construct
  misc_feature 1..432: note = derived and/or modified sequence opt4 from anti-HIV_cap256-048-005999_VR-Chain
  source 1..432: mol_type = other RNA
caggtgcagctggtggagagcggcggcggcgtggtgcagcccggcagaagcctgagactgagctgcgccgccagcggcttcaccttcacccacttcgccatggactgggtgagacaggcccccggcaagggcctggagtgggtggccgtgatcagcagcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacctgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32830 - RNA, 432 nt, synthetic construct
  misc_feature 1..432: note = derived and/or modified sequence opt4 from anti-HIV_cap256-048-005394_VR-Chain
  source 1..432: mol_type = other RNA
caggtgcagctggtggagagcggcggcggcgtggtgcagcccggcagaagcctgagactgagctgcgccgccagccagttcaccttcagcagctacggcatgcactgggtgagacaggcccccggcaagggcctggagtgggtggccgccatcagcttcgccggcaccaacaagtactacgccgacagcgtgaagggcagattcaccatcagcagagacaacagcaagaacgccctgtacctgcagatgaacagcctgagagccgaggacaccgccctgtactactgcgccaaggacctgagagagttcgagtgcgaggagtgggccagcgactactacgacttcggcagagactacccctgccaggaccccagaggcgtggtgggcaccttcgacatctggggccagggcaccatggtgaccgtgagcagc

SEQ ID NO: 32831 - RNA, 432 nt, synthetic construct
  misc_feature 1..432: note = derived and/or modified sequence opt4 from anti-HIV_cap256-048-004226_VR-Chain
  source 1..432: mol_type = other RNA
caggtgcagctggtggagagcggcggcggcgtggtgcagcccggcagaagcctgagactgagctgcgccgccagcggcttcaccttcaacaagcacggcatgcactgggtgagacaggcccccggcaagggcctggagtgggtggccttcgtggccttcgacggcagcgacaagtactacgccgacagcgtgaagggcagattcaccatcagcagagacaacagcaagaacaccctgagcctgcagatgaacaacctgagagccgaggacaccgccgtgtactactgcgccaaggaggtgggcgacaacaaggacgacgagtgggccagcgactactacgacctgagcatcgcctaccccgtgcaggaccccagagccgtggtgggcggctacgacatctggggccagggcaccatggtgaccgtgagcagc

SEQ ID NO: 32832 - RNA, 432 nt, synthetic construct
  misc_feature 1..432: note = derived and/or modified sequence opt4 from anti-HIV_cap256-048-004097_VR-Chain
  source 1..432: mol_type = other RNA
caggtgcagctggtggagagcggcggcggcgtggtgcagcccggcagaagcctgagactgagctgcgccgccagcggcttcaccttcagcgcctacaccgtgcactgggtgagacaggcccccggcagaggcctggagtgggtgagcgtgatcagctacgacgacagaaacaagtactacgcccacagcgtgaagggcagattcaccatcagcagagacaacagcaagaacaccctgtacctgcagatgaacagcctgagaagagaggacaccgccgtgtactactgcgccaaggacctgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32833 - RNA, 432 nt, synthetic construct
  misc_feature 1..432: note = derived and/or modified sequence opt4 from anti-HIV_cap256-048-003289_VR-Chain
  source 1..432: mol_type = other RNA
caggtgcagctggtggagagcggcggcggcgtggtgcagcccggcagaagcctgagactgagctgcgccgccagcggcttcaccttcagcaagtacggcatgcactgggtgagacaggcccccggcaagggcctggagtgggtggccttcgtggccttcgacggcagcagcaagaactacgccgacagcgtgaagggcagattcaccatcagcagagacaacagcaagaacaccgtgagcctgcagatgaacagcctgagacccgaggacaccgccgtgtactactgcgccaaggacctgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32834 - RNA, 432 nt, synthetic construct
  misc_feature 1..432: note = derived and/or modified sequence opt4 from anti-HIV_cap256-048-002601_VR-Chain
  source 1..432: mol_type = other RNA
caggtgcagctggtggagagcggcggcggcgtggtgcagcccggcagaagcctgagactgagctgcgccgccagcggcttcagcttcaacaactacgccatggactgggtgagacaggcccccggcaagggcctggagtgggtggccgtgatcagcagcgacggcagaaacaagaactacgccgagagcgtgaagggcagattcaccatcagcagagacaacagcaagaacaccgtgtacctgcagatgaacagcctgagagccgaggacaccgccgtgtactactgcgccaaggacgtgggcgacaccaagaaggacgagtgggccaccgactactacgacctgagcatcgcctaccccgtgcaggacccccaggccgtggtgggcgccttcgacatctggggccagggcaccatggtgaccgtgagcagc

SEQ ID NO: 32835 - RNA, 432 nt, synthetic construct
  misc_feature 1..432: note = derived and/or modified sequence opt4 from anti-HIV_cap256-048-002129_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccctgatcagctacgacggcaccgacaagtactacgccgacagcgtgaagggcagattcatcatcagcagagacaacagcagaagcaccctgtacctgcagatgaacagcctgagactggaggacaccgccgtgtaccactgcgccaaggacctgggcggcagcaagagcgacgagtgggccaccgactactacgacctgagcgtggcctaccccgtgcaggaccccagagccgtggtgggcgtgttcgacatctggggccagggcaccatggtgaccgtgagcagc

SEQ ID NO: 32836 - RNA, 432 nt, synthetic construct
  misc_feature 1..432: note = derived and/or modified sequence opt4 from anti-HIV_cap256-048-001875_VR-Chain
  source 1..432: mol_type = other RNA
caggtgcagctggtggagagcggcggcggcgtggtgcagcccggcggcagcctgagactgagctgcgccaccagcggcctgaccttcagcaactacggcatgcactgggtgagacaggcccccggcagaggcctggagtgggtggccttcaccagatacgacggcacctacaactactacgccgacagcgtgaagggcagattcaccatcagcagagacaacagcaagggcaccctgtacctgcagatggacggcctgagacccgaggacaccgccctgtactactgcgccaaggacctgggcgagagagagtgcgaggagtgggccagcgactactacgacttcggcagagacttcccctgccaggaccccagaggcgtggtgggcaccttcgacatctggggccagggcaccatggtgaccgtgagcagc

SEQ ID NO: 32837 - RNA, 432 nt, synthetic construct
  misc_feature 1..432: note = derived and/or modified sequence opt4 from anti-HIV_cap256-048-001302_VR-Chain
  source 1..432: mol_type = other RNA
caggtgcagctggtggagagcggcggcggcgtggtgcagcccggcagaagcctgagactgagctgcgccgccagcggcttcaccttcagctacagcggcatgcactgggtgagacaggcccccggcaagggcatggagtgggtggccgtgatcagctacgacggcagcaacaagtactacgccgacagcgtgaagggcagattcaccatcagcagagacaacagcaagaacaccgtgtacctgcagatgaacagcctgagaggcgtggacaccgccgtgtactactgcgccaaggacctgggcggcggcgaggtggaggagtgggccaccgactactacgactggagcatcgcctaccccgtggagcaccccagagccgtggtgggcgtgttcgacatctggggccagggcaccaaggtgaccgtgagcagc

SEQ ID NO: 32838 - RNA, 432 nt, synthetic construct
  misc_feature 1..432: note = derived and/or modified sequence opt4 from anti-HIV_cap256-048-001203_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccatcatcagctacgacggcaccatcaagtactacgccgacagcgtgaagggcagattcaccatcagcagagacaacagcaagaacaccgtgagcctgcagatgaacagcctgagacccgaggacaccgccgtgtactactgcgccaaggacgtgggcgccaacaaggacgacgagtgggccaccgactactacgacctgagcatcgcctaccccgtgcccgaccccagagccgtggtgggcgccttcgacatctggggccagggcaccatggtgaccgtgagcagc

SEQ ID NO: 32839 - RNA, 432 nt, synthetic construct
  misc_feature 1..432: note = derived and/or modified sequence opt4 from anti-HIV_cap256-048-000383_VR-Chain
  source 1..432: mol_type = other RNA
caggtgcagctggtggagagcggcggcggcgtggtgcagcccggcagaagcctgagactgagctgcaccgccagcggcttcaccttcaaccactacgccatggactgggtgagacaggcccccggcaagggcctggagtgggtggccgtgatcagcagcgacggcagcgacaagacctacgccgacagcgtgaagggcagattcaccatcagcagagacaacagcaagaacaccgtgtacctgcagatgaacagcctgagagccgaggacaccgccgtgtactactgcgccaaggacgtgggcggcagcaaggacgacgagtgggccaccgactactacgacctgagcatcgcctaccccgtgcccgaccccagagccgtggtgggcgccttcgacttctggggccccggcaccatggtgaccgtgagcagc

SEQ ID NO: 32840 - RNA, 432 nt, synthetic construct
  misc_feature 1..432: note = derived and/or modified sequence opt4 from anti-HIV_cap256-038-261791_VR-Chain
  source 1..432: mol_type = other RNA
caggtgcagctggtggagttcggcggcggcgtggtgcagcccggcggcagcctgagactgagctgcgccgccttcggcttcaccatcagcagctacggcatgcactgggtgagacaggcccccggcaagggcctgcagtgggtggccttcatcagatacgacgagagcagcaagttctacgccgacagcgtgaagggcagattcaccatcagcagagacaacagcgagaacaccctgtacctgcagatgaacagcctgagagccgaggacaccgccgtgtactactgcgccaaggacctgggcgagagcgagaacgaggagtgggccaccgactactacgacttcagcatcgcctaccccggccaggaccccagaggcgtggtgggcatcttcgacatctggggccagggcaccatggtgaccgtgagcagc

SEQ ID NO: 32841 - RNA, 432 nt, synthetic construct
  misc_feature 1..432: note = derived and/or modified sequence opt4 from anti-HIV_cap256-038-241540_VR-Chain
  source 1..432: mol_type = other RNA
caggtgcagctggtggagagcggcggcggcgtggtgcagcccggcagaagcctgagactgagctgcgccgccagcggcttcaccttcagcaacagcgccatgcactgggtgagacaggcccccggcaagggcctggagtgggtggccctgatcagctacgtgggcggcaacatctactacgccgacagcgtgaagggcagattcaccgtgagcagagacaacagcaagaagaccctgtacctgcagatgaacagcctgagagtggaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32842 - RNA, 432 nt, synthetic construct
  misc_feature 1..432: note = derived and/or modified sequence opt4 from anti-HIV_cap256-038-235677_VR-Chain
  source 1..432: mol_type = other RNA
ctggtgcagctggtggagagcggcggcggcgtggtgcagcccggcggcagcctgagactgagctgcgccgccagcggcttcagattcagcagctacggcatgcactgggtgagacaggcccccggcaagggcctggagtgggtggccttcatcagatacgacggcagcttcaaggactacgccgacagcgtgagaggcagattcaccatcagcagagagaacagcaagaacaccctgtacctgcagatgaacagcctgagaaccgacgacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32843 - RNA, 435 nt, synthetic construct
  misc_feature 1..435: note = derived and/or modified sequence opt4 from anti-HIV_cap256-038-234314_VR-Chain
  source 1..435: mol_type = other RNA
gaggtgcagctgctggagagcggcggcggcctggtgcagcccggcggcagcctgagactgagctgcgccgccagcggcttcaccttcagcagatacgccatgagctgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgtggacaccgccgtgtactactgcgccaaggacctgggcgagggcgagaacgaggagtgggccaccgactactacgacttcagctactggctgccctgccccaagtaccacggcgcctggctggagctgctgtacatctggggccagggcaccatggtgaccgtgagcagc

SEQ ID NO: 32844 - RNA, 432 nt, synthetic construct
  misc_feature 1..432: note = derived and/or modified sequence opt4 from anti-HIV_cap256-038-234273_VR-Chain
  source 1..432: mol_type = other RNA
gaggtgcagctggtggagagcggcggcggcctgatccagcccggcggcagcctgagactgagctgcgccgccagcggcttcaccgtgagcaccaacttcatgagctgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagaaccgacgacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32845 - RNA, 432 nt, synthetic construct
  misc_feature 1..432: note = derived and/or modified sequence opt4 from anti-HIV_cap256-038-223164_VR-Chain
  source 1..432: mol_type = other RNA
gaggtgcagctggtggagagcggcggcggcctggtgagacccggcggcagcctgagactgagctgcgccgccagcggcttcagcctgggcagctactggatgacctgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggaccccagaggcgtggtgggcaccttcgacatctggggccagggcaccatggtgaccgtgagcagc

SEQ ID NO: 32846 - RNA, 432 nt, synthetic construct
  misc_feature 1..432: note = derived and/or modified sequence opt4 from anti-HIV_cap256-038-220289_VR-Chain
  source 1..432: mol_type = other RNA
gaggtgcagctggtggagagcggcggcggcctggtgcagcccggcggcagcctgagactgagctgcaccgccagcggcttcaccttcagcagctacgagatgaactgggtgagacaggcccccggcaagggccccgagtgggtggccgtgatcagctacgacggcaacaacaagtactacgccgacagcgtgaagggcagattcaccatcagcagagagaacagcaagaacaccctgtacctgcagatgaacagcctgagaaccgacgacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32847 - RNA, 432 nt, synthetic construct
  misc_feature 1..432: note = derived and/or modified sequence opt4 from anti-HIV_cap256-038-220020_VR-Chain
  source 1..432: mol_type = other RNA
caggtgcagctggtggagagcggcggcggcgtggtgcagcccggcagaagcctgagactgagctgcgccgccagcggcttcaccttcagcagaaacgccatgcactgggtgagacaggcccccggcaagggcctggagtgggtggccctgatcagctacgacggcagcaacaagtactacgtggacagcgtgaagggcagattcaccatcagcagagacaacagcaagaacaccctgtacctgcagatgaacagcctgagagccgacgacaccgccgtgtactactgcgccaaggacctgggcgagagcgagaccgaggagtggggcaccgactactacgacttcagcaccggctaccccgtgcaggaccccagaggcgtggtgggcgccttcgacatctggggccagggcaccatggtgagcgtgagcagc

SEQ ID NO: 32848 - RNA, 432 nt, synthetic construct
  misc_feature 1..432: note = derived and/or modified sequence opt4 from anti-HIV_cap256-038-216853_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacgtgcagatgaacagcctgagagccgaggacaccgccgtgtactactgcgccagagacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32849 - RNA, 432 nt, synthetic construct
  misc_feature 1..432: note = derived and/or modified sequence opt4 from anti-HIV_cap256-038-213466_VR-Chain
  source 1..432: mol_type = other RNA
gaggtgcagctggtggagagcggcggcggcctggtgcagcccggcagaagcctgagagtgagctgcgccgccagcggcttcaccttcgaggactacgccatgcactgggtgagacaggcccccggcaagggcctggagtgggtggccgtgatcagcgacgacggcaacaacaagtactacgccgacagcgtgaagggcagattcaccatcagcagagacaacagcaagaacaccctgtacctgcagatgaacagcctgagagtggaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32850 - RNA, 432 nt, synthetic construct
  misc_feature 1..432: note = derived and/or modified sequence opt4 from anti-HIV_cap256-038-213212_VR-Chain
  source 1..432: mol_type = other RNA
caggtgcagctggtggagagcggcggcggcgtggtgcagcccggcggcagcctgagactgagctgcgccgccagcggcttcatcttcagcgactacggcatgcactgggtgagacaggcccccggcaagggcctggagtgggtggccagcatctggcacgacggcagcaagaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagatcgaggagtggaccagcgactactacgacttcggcagagactaccccggccaggaccccagaggcgtgttcggcaccttcgacatctggggccacggcaccatggtgaccgtgagcagc

SEQ ID NO: 32851 - RNA, 432 nt, synthetic construct
  misc_feature 1..432: note = derived and/or modified sequence opt4 from anti-HIV_cap256-038-213120_VR-Chain
  source 1..432: mol_type = other RNA
caggtgcacctggtggagagcggcggcggcctggtgaagcccggcggcagcctgagactgagctgcgccgccagcggcttcaccttcagcgactactacatgatctggatcagacaggcccccggcaagggcctggagtgggtggccgtgatcagcagcgacggcagcaacaagaactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcgccaccggctaccccgtgcaggaccccagagccgtggtgggcgccttcgacatctggggccagggcaccatggtgaccgtgagcccc

SEQ ID NO: 32852 - RNA, 432 nt, synthetic construct
  misc_feature 1..432: note = derived and/or modified sequence opt4 from anti-HIV_cap256-038-212592_VR-Chain
  source 1..432: mol_type = other RNA
ctggtgcagctggtggagagcggcggcggcgtggtgcagcccggcaagagcctgagactgagctgcgccgccagcggcttcaccttcagcagctacgccatgcactggatcagacaggcccccggcaagggcctggagtgggtggccgtgatcagcgacgacggcagcatcaagaactacgccgacagcgtgaagggcagattcaccatcagcagagacaccagcaagaagctgatgtacctgcagatgaacagcctgagcgccaacgacaccgccgtgtactactgcgccaaggacctgggcgagagagagaacgaggagtgggccagcgactactacgacttcggcagagactaccccggccaggaccccagaggcgtggtgggcagcatcgacacctggggccacggcaccatggtgaccgtgagcagc

SEQ ID NO: 32853 - RNA, 432 nt, synthetic construct
  misc_feature 1..432: note = derived and/or modified sequence opt4 from anti-HIV_cap256-038-211790_VR-Chain
  source 1..432: mol_type = other RNA
gagctgcagctggtggagagcggcggcggcctggtgcagcccggcggcagcctgagactgagctgcgtggtgagcggcttcaccgtgagcaccaactacatcagctgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggaccccagaggcgtggtgggcaccttcgacatctggggccagggcaccatggtgaccgtgagcagc

SEQ ID NO: 32854 - RNA, 432 nt, synthetic construct
  misc_feature 1..432: note = derived and/or modified sequence opt4 from anti-HIV_cap256-038-209916_VR-Chain
  source 1..432: mol_type = other RNA
caggtgcagctggtggagagcggcggcggcgtggtgcagcccggcggcagcctgagactgagctgcgccgccagcggcttcaccttcagcagcttcggcatgcactgggtgagacaggcccccggcaagggcctggagtgggtgagcttcatcagaaacgacggcggcatcagatacagcgccgacagcgtgagaggcagattcaccatcagcagagacaacagcaagaacaccctgtacctgcagatgaacagcctgagaaccgacgacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32855 - RNA, 432 nt, synthetic construct
  misc_feature 1..432: note = derived and/or modified sequence opt4 from anti-HIV_cap256-038-207938_VR-Chain
  source 1..432: mol_type = other RNA
caggtgcagctggtggagagcggcggcggcgtggtgcaccccggcagaagcctgagactgagctgcgccgccagcggcttcaccttcagcagctacggcatgcactgggtgagacaggcccccggcaagggcctggagtgggtggccgtgatcagccacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagagactaccccggccaggaccccagaggcgtggtgggcgtgttcgacatctggggccagggcaccatggtgaccgtgagcagc

SEQ ID NO: 32856 - RNA, 432 nt, synthetic construct
  misc_feature 1..432: note = derived and/or modified sequence opt4 from anti-HIV_cap256-038-202245_VR-Chain
  source 1..432: mol_type = other RNA
caggtgcacctggtggagagcggcggcggcgtggtgcagcccggcagaagcctgagactgagctgcaccgtgagcggcttcaccttcggcagctacgccctgcactgggtgagacaggcccccggcaagggcctggagtggctgagcgtgatcagctacgacggcaacaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagaaggaggagtgggccagcgactactacgacttcggcagagactaccccggccaggaccccagaggcgtggtgggcaccttcgacatctggggccacggcaccatggtgaccgtgagcagc

SEQ ID NO: 32857 - RNA, 432 nt, synthetic construct
  misc_feature 1..432: note = derived and/or modified sequence opt4 from anti-HIV_cap256-038-197721_VR-Chain
  source 1..432: mol_type = other RNA
caggtgcagctggtggagagcggcggcggcgtggtgcagcccggcaagagcctgagactgagctgcgccggcagcggcttcatcttcagcaactaccccatgcactgggtgagacaggcccccggcaagggcctggagtggatggccgacgtgagctacgacggcagcaacaaggactacgccgacagcgtgaagggcagattcaccatcagcagagacaacagcaagaacaccctgtacctgcagatgaacagcctgagagccgaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32858 - RNA, 432 nt, synthetic construct
  misc_feature 1..432: note = derived and/or modified sequence opt4 from anti-HIV_cap256-038-196679_VR-Chain
  source 1..432: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtggccgtgatcagctacgacggcggcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggacagcagaggcgtggtgggcaccttcgacgtgtggggccagggcaccatggtgaccgtgagcagc

SEQ ID NO: 32859 - RNA, 438 nt, synthetic construct
  misc_feature 1..438: note = derived and/or modified sequence opt4 from anti-HIV_cap256-038-196118_VR-Chain
  source 1..438: mol_type = other RNA
caggtgcagctggtggagagcggcggcggcgtggtgcagcccggcggcagcctgagactgagctgcgccgccagcggcttcaccttcagcacctacggcatgcactgggtgagacaggcccccggcaagggcctggagtgggtgaccttcatcagaaacgacggcaccaacaagtactacgccgacagcgtgaagggcagattcaccatcagcagagacaacaccaagaacaccctgtacctgcagatgtacagcctgagagccgaggacaccgccgtgtactactgcgccaaggacctgggcgagagcgagaacgaggacgaggagtgggccagcgactactacgacttcggcagagactaccccggccaggacagcagaggcgtggtgggcaccttcgacatgtggggccagggcaccatggtgaccgtgagcagc

SEQ ID NO: 32860 - RNA, 429 nt, synthetic construct
  misc_feature 1..429: note = derived and/or modified sequence opt4 from anti-HIV_cap256-038-195382_VR-Chain
  source 1..429: mol_type = other RNA
caggtgcacctggtggagagcggcggcggcgtggtgcagcccggcagaagcctgagactgagctgcgccgccagcggcttcaccttcagcaactaccccgtgcactgggtgagacaggcccccggcaagggcctggagtgggtggccgtgatcagcttcgacggcatcaacaactacgccggcagcgtgaagggcagattcatcatcagcagagacaacagcaagaacaccctgtacctgcagatgaacagcctgagagccgaggacaccgccgtgtactactgcgtgaaggacctgggcgagagcgagaaggaggagtggcccagcgactactacgacttcggcagagactaccccggccaggacagcagaggcgtggtgggcgtgttcgacatctggggccagggcaccatggtgaccgtgagcagc

SEQ ID NO: 32861 - RNA, 432 nt, synthetic construct
  misc_feature 1..432: note = derived and/or modified sequence opt4 from anti-HIV_cap256-038-180001_VR-Chain
  source 1..432: mol_type = other RNA
gaggtgcagctggtggagagcggcggcggcctggtgcagcccggcagaagcctgagactgagctgcaccgccagcggcttcaccttcggcgactacgccatgagctggttcagacaggcccccggcaagggcctggagtgggtggccgacatcagctacgacggcagcaacaagtactacgccgacagcgtgaagggcagactgaccatcagcagagacaacagcaagaacaccctgtacctgcagatgaacagcctgagagccgaggacaccgccgtgtactactgcgtgaaggacctgggcgagagcgagaaggaggagtggcccagcgactactacgacttcggcagagactaccccggccaggacagcagaggcgtggtgggcgtgttcgacatctggggccagggcaccatggtgaccgtgagcagc

SEQ ID NO: 32862 - RNA, 432 nt, synthetic construct
  misc_feature 1..432: note = derived and/or modified sequence opt4 from anti-HIV_cap256-038-178021_VR-Chain
  source 1..432: mol_type = other RNA
caggtgaagctggtggagagcggcggcggcgtggtgcagcccggcggcagcctgagactgagctgcgccgccgccggcttcatcttcagcaacagcggcatgcactgggtgagacaggcccccgacaagggcctggagtgggtggccttcgtgccctacgacggcagcaacaagtactacgccgacagcgtgaagggcagattcaccatcagcagagacaacagcaagaacaccctgagcctgcagatgaacagcctgagaaccgaggacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32863 - RNA, 432 nt, synthetic construct
  misc_feature 1..432: note = derived and/or modified sequence opt4 from anti-HIV_cap256-038-177104_VR-Chain
  source 1..432: mol_type = other RNA
gaggtgcagctgctggagagcggcggcggcctggtgcagcccggcggcagcctgagactgagctgcgccgccagcggcttcaccttcagcagctacgccatgaactgggtgagacaggcccccggcaagggcctggagtgggtggccgtgatcagctacgacggcggcgacaagtactacgccgacagcgtgaagggcagattcaccatcagcagagacaacagcaagaacaccctgtacctgcagatgaacagcctgagagtggaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32864 - RNA, 432 nt, synthetic construct
  misc_feature 1..432: note = derived and/or modified sequence opt4 from anti-HIV_cap256-038-171261_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgtactgggtgagacaggcccccggcaagggcctggagtgggtggccgtgatcagcagcgacggcagcgacaagaactacgccgacagcgtgaagggcagattcaccatcagcagagacaacagcaacaacaccctgtacctgcagatgaacagcctgagagccgaggacaccgccgtgtactactgcgccagagacctgggcgagagcgagaacgaggagtggcccagcgactactacgacttcggcagagactaccccggccaggaccccagaggcgtgatcggcaccttcgacgtgtggggccagggcaccatggtgaccgtgagcagc

SEQ ID NO: 32865 - RNA, 432 nt, synthetic construct
  misc_feature 1..432: note = derived and/or modified sequence opt4 from anti-HIV_cap256-038-169090_VR-Chain
  source 1..432: mol_type = other RNA
caggtgcagctggtggagagcggcggcggcgtggtgcagcccggcagaagcctgagactgagctgcgccgccagcagattcaccttcaagacctacaccatgcactgggtgagacaggcccccggcaagggcctggagtgggtggccctgatcagctacgacggcagcaacaagtactacgccgacagcgtgaagggcagactgaccatcagcagagacaacagcaagaacaccctgtacctgcagatgaacagcctgagagccgaggacaccgccgtgtactactgcgtgaaggacctgggcgagagcgagaaggaggagtggcccagcgactactacgacttcggcagagactaccccggccaggacagcagaggcgtggtgggcgtgttcgacatctggggccagggcaccatggtgaccgtgagcagc

SEQ ID NO: 32866 - RNA, 432 nt, synthetic construct
  misc_feature 1..432: note = derived and/or modified sequence opt4 from anti-HIV_cap256-038-168705_VR-Chain
  source 1..432: mol_type = other RNA
gaggtgcagctggtggagagcggcggcggcctggtgaagcccggcggcagcctgagactgagctgcgccgccagcggcttcaccttcagcagctacagcatgaactgggtgagaagagcccccggcaagggcctggagtgggtggccctgatcagctacgacgagaacaagaagtactacgccgacagcgtgaagggcagattcaccatcagcagagagaacagcaagaacaccctgtacctgcagatgaacagcctgagagccgaggacaccgccgtgtactactgcgccaaggacctgggcgagagagagaacgaggagtgggccagcgactactacgacttcggcagagactaccccggccaggaccccagaggcgtggtgggcagcatcgacacctggggccacggcaccatggtgaccgtgagcagc

SEQ ID NO: 32867 - RNA, 432 nt, synthetic construct
  misc_feature 1..432: note = derived and/or modified sequence opt4 from anti-HIV_cap256-038-167685_VR-Chain
  source 1..432: mol_type = other RNA
caggtgcagctggtggagagcggcggcggcgtggtgcagcccggcagaagcctgagactgagctgcgccgccagcggcatcaccttcagcagctacgccatccactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcatcggctaccccggccaggaccccagaggcgtggtgggcgccttcgacatctggggccagggcaccatggtgaccgtgagcctg

SEQ ID NO: 32868 - RNA, 432 nt, synthetic construct
  misc_feature 1..432: note = derived and/or modified sequence opt4 from anti-HIV_cap256-038-158775_VR-Chain
  source 1..432: mol_type = other RNA
caggtgcagctggtggagagcggcggcggcgtggtgcagcccggcggcagcctgagactgagctgcgccgccagcggcttcaccttcagcacctacggcatgcactgggtgagacaggcccccggcaagggcctggagtgggtggccttcatcagagacaacggcagcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggacagcagaggcgtggtgggcaccttcgacgtgtggggccagggcaccatggtgaccgtgagcagc

SEQ ID NO: 32869 - RNA, 432 nt, synthetic construct
  misc_feature 1..432: note = derived and/or modified sequence opt4 from anti-HIV_cap256-038-157318_VR-Chain
  source 1..432: mol_type = other RNA
cacgtgcagctggtggagagcggcggcggcgtggtgcagcccggcagaagcctgagactgagctgcgccgccagcggcatcaccttcagcacctacgacatgcactgggtgagacaggcccccggcaagggcctggagtgggtggccgtgatcagcaacgacggcagcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaaggaggagtgggccagcgactactacgacttcggcagagactaccccggccaggaccccagaggcgtggtggccaccttcgacatctggggccagggcaccatggtgaccgtgagcagc

SEQ ID NO: 32870 - RNA, 432 nt, synthetic construct
  misc_feature 1..432: note = derived and/or modified sequence opt4 from anti-HIV_cap256-038-153058_VR-Chain
  source 1..432: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccgtgatcagctacgacggcagccacagctactacgccggcagcgtgaagggcagattcaccaccagcagagacaacagcaagaacaccctgaacctgcagatgaacagcctgagacccgaggacaccgccctgtactactgcgccaaggacctgggcgagagcgagaacgaggagtgggccagcgactactacgacttcggcagagactaccccggccaggacagcagaggcgtggtgggcaccttcgacgtgtggggccagggcaccatggtgaccgtgagcagc

SEQ ID NO: 32871 - RNA, 432 nt, synthetic construct
  misc_feature 1..432: note = derived and/or modified sequence opt4 from anti-HIV_cap256-038-150027_VR-Chain
  source 1..432: mol_type = other RNA
ctggtgcagctggtggagagcggcggcggcgtggtgcagcccggcggcagcctgagactgagctgcgccgccagcggcttcagattcagcagctacggcatgcactgggtgagacaggcccccggcaagggcctggagtgggtggccttcatcagatacgacggcagcttcaaggactacgccgacagcgtgagaggcagattcaccatcagcagagacaacagcaagaacaccgtgtacgtgcagatgaacagcctgagagccgaggacaccgccgtgtactactgcgccaaggacctgggcgagagcgagaacgaggagtgggccaccgactactacgacttcgccaccggctaccccgtgcaggaccccagagccgtggtgggcgccttcgacatctggggccagggcaccatggtgaccgtgagcccc

SEQ ID NO: 32872 - RNA, 432 nt, synthetic construct
  misc_feature 1..432: note = derived and/or modified sequence opt4 from anti-HIV_cap256-038-146372_VR-Chain
  source 1..432: mol_type = other RNA
caggtgcagctggtggagagcggcggcggcgtggtgcagcccggcagaagcctgagactgagctgcgccgccagcggcttcaccttcagcagcttcggcatgcactgggtgagacagagccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagaaccgacgacaccgccgtgtactactgcgccaaggacctgggcgagagcgagaccgaggagtgggccaccgactactacgacttcgccaccggctaccccgtgcaggaccccagagccgtggtgggcgccttcgacatctggggccagggcaccatggtgaccgtgagcccc

SEQ ID NO: 32873 - RNA, 432 nt, synthetic construct
  misc_feature 1..432: note = derived and/or modified sequence opt4 from anti-HIV_cap256-038-141868_VR-Chain
  source 1..432: mol_type = other RNA
gagctgagactggtggagagcggcggcaacctggtgcagcccggcggcagcctgaccctgagctgcgtggccagcggcttcaccttcgacagctacggcatgagctgggtgagacaggcccccggcaagggcctggagtgggtggccctgatcagctacgacgagaacaagaagtactacgccgacagcgtgaagggcagattcaccatcagcagagagaacagcaagaacaccctgtacctgcagatgaacagcctgagagccgaggacaccgccgtgtactactgcgccaaggacctgggcgagagagagaacgaggagtgggccagcgactactacgacttcggcagagactaccccggccaggaccccagaggcgtggtgggcagcatcgacacctggggccacggcaccatggtgaccgtgagcagc

SEQ ID NO: 32874 - RNA, 432 nt, synthetic construct
  misc_feature 1..432: note = derived and/or modified sequence opt4 from anti-HIV_cap256-038-141616_VR-Chain
  source 1..432: mol_type = other RNA
gaggtgcagctgctggagagcggcggcggcctggtgcagcccggcggcagcctgagactgagctgcgccgccagcggcttcaccttcagcagctacgccatgagctgggtgagacaggcccccggcaagggcctggagtgggtggccgtgatcagcaaggacggcagcgacaacagctacgtggacagcgtgaagggcagattcaccatcagcagagacaacagcaagaacaccctgtacctgcagatgaacagcctgagagccgaggacaccgccgtgtactactgcgccagagacctgggcgagagcgagaacgaggagtggcccagcgactactacgacttcggcagagactaccccggccaggaccccagaggcgtgatcggcaccttcgacgtgtggggccagggcaccatggtgaccgtgagcagc

SEQ ID NO: 32875 - RNA, 432 nt, synthetic construct
  misc_feature 1..432: note = derived and/or modified sequence opt4 from anti-HIV_cap256-038-127989_VR-Chain
  source 1..432: mol_type = other RNA
caggcccagctggtggagagcggcggcggcgtggtgcagcccggcagaagcctgagactgagctgcgccgccagcggcttcaccttcagcaacttcgccatgcactgggtgagacaggcccccggcaagggcctggagtgggtggccgtgatgagcgacgacggcagcaacaagtactacgccgacagcgtgaagggcagattcaccatcagcagagacaacagcgagaacaccctgtacctgcagatgaacagcctgagagccgaggacaccgccgtgtactactgcgccaaggacctgggcgagagcgagaccgaggagtgggccaccgactactacgacttcggcaccggctaccccggccaggaccccagagccatgatcggcaccttcgacatctggggcagaggcaccatggtgaccgtgagcagc

SEQ ID NO: 32876 - RNA, 432 nt, synthetic construct
  misc_feature 1..432: note = derived and/or modified sequence opt4 from anti-HIV_cap256-038-118109_VR-Chain
  source 1..432: mol_type = other RNA
caggtgcagctggtggagagcggcggcggcgtggtgcagcccggcggcagcctgagactgagctgcaccgccagcggcttcaccttcagcgcctacgacatgcactggatcagacaggcccccggcaagggcctgggctgggtggccttcatcaccaacgagggcagcagcaagaactacgtggacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcatcgcctaccccggccaggaccccagaggcgtggtgggcatcttcgacatctggggccagggcaccatggtgaccgtgagcagc

SEQ ID NO: 32877 - RNA, 432 nt, synthetic construct
  misc_feature 1..432: note = derived and/or modified sequence opt4 from anti-HIV_cap256-038-112226_VR-Chain
  source 1..432: mol_type = other RNA
gaggtgcagctggtggagagcggcggcggcctggtgcagcccggcggcagcctgagactgagctgcgccgccagcggcttcaccttcagcagctactggatgacctgggtgagacaggcccccggcaagggcctggagtgggtggccgtgatcagcgacgacggcaacaacaagtactacgccgacagcgtgaagggcagattcaccatcagcagagacaacagcaagaacaccctgtacctgcagatgaacagcctgagagtggaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32878 - RNA, 432 nt, synthetic construct
  misc_feature 1..432: note = derived and/or modified sequence opt4 from anti-HIV_cap256-038-105918_VR-Chain
  source 1..432: mol_type = other RNA
gaggtgcagctgctggagagcggcggcggcctggtgcagcccggcggcagcctgagactgagctgcgccgccagcggcttcaccttcaacatccaccccatgcactgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagaaccgacgacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32879 - RNA, 432 nt, synthetic construct
  misc_feature 1..432: note = derived and/or modified sequence opt4 from anti-HIV_cap256-038-104487_VR-Chain
  source 1..432: mol_type = other RNA
ctggtgcagctggtggagagcggcggcggcgtggtgcagcccggcaagagcctgagactgagctgcgccgccagcggcttcaccttcagcagctacgccatgcactggatcagacaggcccccggcaagggcctggagtgggtggccgtgatcagcgacgacggcagcatcaagaactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacggcttcagcatcggctaccccggccaggaccccagaggcgtggtgggcatcttcgacatctgggcccagggcaccatggtgaccgtgagcagc

SEQ ID NO: 32880 - RNA, 432 nt, synthetic construct
  misc_feature 1..432: note = derived and/or modified sequence opt4 from anti-HIV_cap256-038-102308_VR-Chain
  source 1..432: mol_type = other RNA
caggtgcagctggtggagagcggcggcggcgtggtgcagcccggcggcagcctgagactgagctgcgccgccctggacttccccttcagcagcttcggcatgcactgggtgagacagacccccggcagaggcctggagtgggtggccatcatctggagcgacggcagcaacagatactacgtggacagcgtgaagggcagattcaccatcagcagagacaacagcaagaacaccctgtacctgcagatgaacagcctgagacccgacgacaccgccgtgtactactgcgtgaaggacctgggcgagagcgagaacgaggagtgggccaccgactactacgacttcagcgtgggctaccccggccagggccccagaggcgtggtgggcatcttcgacatctggggccagggcaccatggtgaccgtgagcagc

SEQ ID NO: 32881 - RNA, 432 nt, synthetic construct
  misc_feature 1..432: note = derived and/or modified sequence opt4 from anti-HIV_cap256-038-091115_VR-Chain
  source 1..432: mol_type = other RNA
caggtgcagctggtggagagcggcggcggcgtggtgcagcccggcagaagcctgagactgagctgcgccgtgagcggcttcaccttcagcagctacggcctgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatcaacagcctgagagccgaggacaccgccgtgtactactgcgccaaggacctgggcgagagcgagaacgaggagtgggccaccgactactacgacttcagcatcggctaccccggccaggaccccagagccgtggtgggcgccttcgacatctggggccagggcaccatggtgaccgtgagcagc

SEQ ID NO: 32882 - RNA, 432 nt, synthetic construct
  misc_feature 1..432: note = derived and/or modified sequence opt4 from anti-HIV_cap256-038-090262_VR-Chain
  source 1..432: mol_type = other RNA
caggtgcagctggtggagagcggcggcggcgtggtgcaggccggcggcagcctgagactgagctgcgccgccagcggcttcaccttcaacaactacggcatgcactgggtgagacaggcccccggcaagggcctggagtgggccgccttcatcagatacgacggcagcaacaagtactacgccgacagcgtgagaggcagattcaccatcagcagagacaacagcaagaacaccctgtacctgcagatgaacagcctgagagccgaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32883 - RNA, 432 nt, synthetic construct
  misc_feature 1..432: note = derived and/or modified sequence opt4 from anti-HIV_cap256-038-083260_VR-Chain
  source 1..432: mol_type = other RNA
caggtgcagctggtggagagcggcggcggcctggtgaagcccggcggcagcctgagactgagctgcgccgccagcggcttcaccttcagcgactactacatgacctggatcagacaggcccccggcaagggcctggagtgggtggccgtgatcagctacgacggcggcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggacagcagaggcgtggtgggcaccttcgacgtgtggggccagggcaccatggtgaccgtgagcagc

SEQ ID NO: 32884 - RNA, 432 nt, synthetic construct
  misc_feature 1..432: note = derived and/or modified sequence opt4 from anti-HIV_cap256-038-080981_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcatggagtgggtggccgtgatcagctacgacggcagcaacaagtactacgccgacagcgtgaagggcagattcaccatcagcagagacaacagcaagaacaccctgtacctgcagatgaacagcctgagagccgtggacaccgccgtgtactactgcgccaaggacctgggcgagggcgagaacgaggagtgggccaccgactactacgacttcagcatcggctaccccggccaggaccccagaggcgtggtgggcgccttcgacatctggggccagggcaccatggtgaccgtgagcagc

SEQ ID NO: 32885 - RNA, 432 nt, synthetic construct
  misc_feature 1..432: note = derived and/or modified sequence opt4 from anti-HIV_cap256-038-080873_VR-Chain
  source 1..432: mol_type = other RNA
ctggtgcagctggtggagagcggcggcggcgtggtgcagcccggcggcagcctgagactgagctgcgccgccagcggcttcagattcagcagctacggcatgcactgggtgagacaggcccccggcaagggcctggagtgggtggccttcatcagatacgacggcagcttcaaggactacgccgacagcgtgagaggcagattcaccatcagcagagacaacagcaagaacaccgtgtacctgcagatgaacagcctgagagccgaggacaccgccgtgtactactgcgtgaaggacctgggcgagagcgagaaggaggagtggcccagcgactactacgacttcggcagagactaccccggccaggacagcagaggcgtggtgggcgtgttcgacatctggggccagggcaccatggtgaccgtgagcagc

SEQ ID NO: 32886 - RNA, 432 nt, synthetic construct
  misc_feature 1..432: note = derived and/or modified sequence opt4 from anti-HIV_cap256-038-074413_VR-Chain
  source 1..432: mol_type = other RNA
caggtgcagctggtggagagcggcggcggcgtggtgcagcccggcggcagcctgagactgagctgcgccgccagcggcttcaccttcagcacctacggcatgcactgggtgagacagccccccggcaagggcctggagtgggtggccttcatcagatacgacggcagcaacacctactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccagcgactactacgacttcggcagagactaccccggccaggaccccagaggcgtggtgggcgtgttcgacatctggggccagggcaccatggtgaccgtgagcagc

SEQ ID NO: 32887 - RNA, 432 nt, synthetic construct
  misc_feature 1..432: note = derived and/or modified sequence opt4 from anti-HIV_cap256-038-073153_VR-Chain
  source 1..432: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccctgatcagctacgacggcaccaacaagtactacgccgacagcgtgaagggcagattcaccatcagcagagacaacagcaagaacaccctgttcctgcagatgaacagcctgagagccgaggacaccgccctgtactactgcgccaaggacctgggcgagagcgagaacgaggagtgggccagcgactactacgacttcggcagagactaccccggccaggaccccagaggcgtggtgggcaccttcgacatctggggccagggcaccatggtgaccgtgagcagc

SEQ ID NO: 32888 - RNA, 432 nt, synthetic construct
  misc_feature 1..432: note = derived and/or modified sequence opt4 from anti-HIV_cap256-038-064227_VR-Chain
  source 1..432: mol_type = other RNA
gaggtgcaggtggtggagagcggcggcggcctggtgcagcccggcggcagcctgagactgagctgcgccgccagcggcttcaccttcagcaactactggatgagctgggtgagacaggcccccggcaagggcctggagtgggtggccgtgatgagcttcagcggcagcggcagctactacgccgacagcgtgaagggcagattcaccatcagcagcgacgacagcatgaacaccgtgtacctgcagatgaacagcctgagagccgaggacaccgccgtgtactactgcgccaaggacctgggcgagagagagaacgaggagtgggccagcgactactacgacttcggcagagactaccccggccaggaccccagaggcgtggtgggcagcatcgacacctggggccacggcaccatggtgaccgtgagcagc

SEQ ID NO: 32889 - RNA, 432 nt, synthetic construct
  misc_feature 1..432: note = derived and/or modified sequence opt4 from anti-HIV_cap256-038-061640_VR-Chain
  source 1..432: mol_type = other RNA
caggtgcagctggtggagagcggcggcggcgtggtgcagcccggcagaagcctgagactgagctgcaccgccagcagattcagcttcaacaactacgccatgcactgggtgagacaggcccccggcaagggcctggagtgggtggccatcatcagcaaggacggcagcgacaacagctacgtggacagcgtgaagggcagattcaccatcagcagagacaacagcaagaacaccctgtacctgcagatgaacagcctgagagccgaggacaccgccgtgtactactgcgccagagacctgggcgagagcgagaacgaggagtggcccagcgactactacgacttcggcagagactaccccggccaggaccccagaggcgtgatcggcaccttcgacgtgtggggccagggcaccatggtgaccgtgagcagc

SEQ ID NO: 32890 - RNA, 414 nt, synthetic construct
  misc_feature 1..414: note = derived and/or modified sequence opt4 from anti-HIV_cap256-038-059482_VR-Chain
  source 1..414: mol_type = other RNA
agaggcgtgcagtgccaggtgcagctggtggagagcggcggcggcgtggtgcagcccggcttcaccttcagcagctacgtgatgcactgggtgagacaggcccccggcaagggcctggagtgggtggccgacatcagctacgacggcagcaacaagtactacgccgacagcgtgaagggcagactgaccatcagcagagacaacagcaagaacaccctgtacctgcagatgaacagcctgagagccgaggacaccgccgtgtactactgcgtgaaggacctgggcgagagcgagaaggaggagtggcccagcgactactacgacttcgccaccggctaccccgtgcaggaccccagagccgtggtgggcgccttcgacatctggggccagggcaccatggtgaccgtgagcccc

SEQ ID NO: 32891 - RNA, 432 nt, synthetic construct
  misc_feature 1..432: note = derived and/or modified sequence opt4 from anti-HIV_cap256-038-054000_VR-Chain
  source 1..432: mol_type = other RNA
gaggtgcagctggtggagagcggcggcagcgtggtgagacccggcggcagcctgagactgagctgcgccgccagcggcttcaccttcgacgacagcggcatgagctgggtgagacagggccccggcaagggcctggagtgggtggccgtgatcagctacgacggcggcaacaagtactacgccgacagcgtgaagggcagattcaccatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggacagcagaggcgtggtgggcaccttcgacgtgtggggccagggcaccatggtgaccgtgagcagc

SEQ ID NO: 32892 - RNA, 432 nt, synthetic construct
  misc_feature 1..432: note = derived and/or modified sequence opt4 from anti-HIV_cap256-038-050554_VR-Chain
  source 1..432: mol_type = other RNA
gaggtgcagctgctggagagcggcggcgacctggtgcagagcggcggcagcctgagactgagctgcgtggccagcggcttcaccttcagcacccacgccatgacctgggtgagacaggcccccggcaagggcctggagtgggtggccgtgatcagcagcgacggcagcaacaagaacttcgccgacagcgtgaagggcagattcaccatcagcagagacaacagcaagaacaccctgtacctgcagatgaacagcctgagacccgaggacaccgccgtgtactactgcgccaaggacctgggcgagagcgagaacgaggagtgggccaccgactactacgacttcagcaccggctaccccgtgcaggaccccagagccgtggtgggcgccttcgacatctggggccagggcaccatggtgaccgtgagcagc

SEQ ID NO: 32893 - RNA, 432 nt, synthetic construct
  misc_feature 1..432: note = derived and/or modified sequence opt4 from anti-HIV_cap256-038-044256_VR-Chain
  source 1..432: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacaagtaccacgccggcagcgtgaagggcagattcatcatcagcagagacaacagcaagaacaccctgtacctgcagatgaacagcctgagagccgaggacaccgccctgtactactgcgccaaggacctgggcgagagcgagaacgaggagtgggccagcgactactacgacttcggcagagactaccccggccaggaccccagaggcgtggtgggcaccttcgacatctggggccagggcaccatggtgaccgtgagcagc

SEQ ID NO: 32894 - RNA, 432 nt, synthetic construct
  misc_feature 1..432: note = derived and/or modified sequence opt4 from anti-HIV_cap256-038-040944_VR-Chain
  source 1..432: mol_type = other RNA
caggtgcagctggtggagagcggcggcggcgtggtgcagcccggcagaagcctgagactgagctgcgccgccagcggcttcaccttcagcaactacgccatggactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcaccggctaccccggccaggaccccagagccgtggtgggcgccttcgacatctggggccagggcaccatggtgaccgtgagcagc

SEQ ID NO: 32895 - RNA, 432 nt, synthetic construct
  misc_feature 1..432: note = derived and/or modified sequence opt4 from anti-HIV_cap256-038-040090_VR-Chain
  source 1..432: mol_type = other RNA
caggtgcagctggtggagagcggcggcggcgtggtgcagcccggcagaagcctgagactgagctgcgccgccagcggcttcagcttcagcaactacgccatggactgggtgagacaggcccccggcaagggcctggagtgggtggccgtgatcagcagcgacggcagcaacaagaactacgccgacagcgtgaagggcagattcaccatcagcagagacaacagcaagaacaccctgtacctgcagatggacagcctgagagccgacgacaccgccgtgtactactgcgccaaggacctgggcgagagcgagaacgaggagtgggccaccgactactacgacttcagcatcggctaccccgtgcaggaccccagaggcgtggtgggcatcttcgacatctggggccagggcaccatggtgaccgtgagcagc

SEQ ID NO: 32896 - RNA, 432 nt, synthetic construct
  misc_feature 1..432: note = derived and/or modified sequence opt4 from anti-HIV_cap256-038-032874_VR-Chain
  source 1..432: mol_type = other RNA
caggtgcagctggtggagagcggcggcggcgtggtgcagcccggcggcagcctgagactgagctgcgccgccagcggcttcaccttcagcagctacggcatgcactgggtgagacaggcccccggcaagggcctggagtgggtggccttcatcagatacgacggcaacaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagaaggaggagtgggccagcgactactacgacttcggcagagactaccccggccaggaccccagaggcgtggtgggcaccttcgacatctggggccacggcaccatggtgaccgtgagcagc

SEQ ID NO: 32897 - RNA, 432 nt, synthetic construct
  misc_feature 1..432: note = derived and/or modified sequence opt4 from anti-HIV_cap256-038-025899_VR-Chain
  source 1..432: mol_type = other RNA
caggtgcagctggtggagagcggcggcggcgtggtgcagcccggcagaagcctgagactgagctgcgtggccagcggcttcaccttcagcaactacgccatgtactgggtgagacaggcccccggcaagggcctggagtgggtgaccatcatcagcttcgacggcagcaaccagtactacgccgacagcgtgaagggcagattcaccatcagcagagagaacagcaagaacaccctgtacctgcagatgaacagcctgagagccgaggacaccgccgtgtactactgcgccaaggacctgggcgagagagagaacgaggagtgggccagcgactactacgacttcggcagagactaccccggccaggaccccagaggcgtggtgggcagcatcgacacctggggccacggcaccatggtgaccgtgagcagc

SEQ ID NO: 32898 - RNA, 432 nt, synthetic construct
  misc_feature 1..432: note = derived and/or modified sequence opt4 from anti-HIV_cap256-038-024581_VR-Chain
  source 1..432: mol_type = other RNA
cacatccagctggtggagagcggcggcggcgtggtgcagcccggcggcagcctgagactgagctgcgccgccagcggcttccccttcagcagcttcggcatgcactgggtgagacagacccccggcagaggcctggagtgggtggccatcatctggagcgacggcagccacaaggagtacaccgacagcgtgaagggcagattcaccatcagcagagacaacagcagaagcaccatggacctgcagatgaacaacctgagacccgaggacaccgccgtgtactactgcgccaaggacctgggcgagagagagaacgaggagtgggccagcgactactacgacttcggcagagactaccccggccaggaccccagaggcgtggtgggcagcatcgacacctggggccacggcaccatggtgaccgtgagcagc

SEQ ID NO: 32899 - RNA, 432 nt, synthetic construct
  misc_feature 1..432: note = derived and/or modified sequence opt4 from anti-HIV_cap256-038-013345_VR-Chain
  source 1..432: mol_type = other RNA
caggtgcagctggtggagagcggcggcggcgtggtgcagcccggcagaagcctgagactgagctgcgccgtgagcggcttcaccttcagcagctacggcatgcactgggtgagacaggcccccggcaagggcctggagtgggtggccgccatcagctacgacggcagcaacaagtactacgtggacagcgtgaagggcagattcaccatcagcagagacaacagcaagaacaccctgtacctgcagatgaacagcctgagagccgaggacaccgccgtgtactactgcgccagagacctgggcgagagagagatcgaggagtgggccaccgactactacgacttcagcatcggctaccccggccaggaccccagaggcgtggtgggcgtgttcgacatctggggccagggcaccatggtgaccgtgagcagc

SEQ ID NO: 32900 - RNA, 438 nt, synthetic construct
  misc_feature 1..438: note = derived and/or modified sequence opt4 from anti-HIV_cap256-038-011559_VR-Chain
  source 1..438: mol_type = other RNA
caggtgcagctggtggagagcggcggcggcgtggtgcagcccggcagaagcctgagactgagctgcgaggccagcggcttcaccttcagcagctacggcatggactgggtgagacaggcccccggcaagggcctggagtgggtggccctgatcagccacgacggcagcaacaagcactacgccgacagcgtgaagggcagattcaccatcagcagagacaacagcagaaacaccctgtacctgcagatgaacagcctgagagccgaggacaccgccctgtactactgcgccaaggacctgggcgagagcgagaacgaggacgaggagtgggccagcgactactacgacttcggcagagactaccccggccaggacagcagaggcgtggtgggcaccttcgacatgtggggccagggcaccatggtgaccgtgagcagc

SEQ ID NO: 32901 - RNA, 432 nt, synthetic construct
  misc_feature 1..432: note = derived and/or modified sequence opt4 from anti-HIV_cap256-038-009634_VR-Chain
  source 1..432: mol_type = other RNA
caggtgcagctggtggagagcggcggcggcgtggtgcagcccggcagaagcctgagactgagctgcgccgccagcggcttcaccttcaccagcttcggcatgcactgggtgagacaggcccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagagccgaggacaccgccgtgtaccactgcgccaaggacctgggcgagagcgagatcgaggagtggaccagcgactactacgacttcggcagagactaccccggccaggaccccagaggcgtgttcggcaccttcgacatctggggccacggcaccatggtgaccgtgagcagc

SEQ ID NO: 32902 - RNA, 432 nt, synthetic construct
  misc_feature 1..432: note = derived and/or modified sequence opt4 from anti-HIV_cap256-038-006730_VR-Chain
  source 1..432: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagcaaggacggcagcgacaacagctacgtggacagcgtgaagggcagattcaccatcagcagagacaacagcaagaacaccctgtacctgcagatgaacagcctgagagccgaggacaccgccgtgtactactgcgccagagacctgggcgagagcgagaacgaggagtggcccagcgactactacgacttcggcagagactaccccggccaggaccccagaggcgtgatcggcaccttcgacgtgtggggccagggcaccatggtgaccgtgagcagc

SEQ ID NO: 32903 - RNA, 432 nt, synthetic construct
  misc_feature 1..432: note = derived and/or modified sequence opt4 from anti-HIV_cap256-038-004887_VR-Chain
  source 1..432: mol_type = other RNA
caggtgcagctggtggagagcggcggcggcgtggtgcagcccggcagaagcctgagactgagctgcgccgccagcggcttcagcttcagcaccagcggcatgcactgggtgagacaggcccccggcaagggcatggagtgggtggccgtgatcagctacgacggcagcaacaagtactacgccgacagcgtgaagggcagattcaccatcagcagagacaacagcaagaacaccctgtacctgcagatgaacagcctgagagccgtggacaccgccgtgtactactgcgccaaggacctgggcgagggcgagaacgaggagtgggccaccgactactacgacttcagcatcggctaccccgtgcagaaccccagaggcctggtgggcgccttcgacatctggggccagggcaccatggtgaccgtgagcagc

SEQ ID NO: 32904 - RNA, 432 nt, synthetic construct
  misc_feature 1..432: note = derived and/or modified sequence opt4 from anti-HIV_cap256-038-004840_VR-Chain
  source 1..432: mol_type = other RNA
caggtgcagctggtggagagcggcggcggcgtggtgcagcccggcagaagcctgagactgagctgcgccgccagcggcttcaccttcagcagcttcggcatgcactgggtgagacagagccccggcaagggcctggagtgggtggccgtgatcagctacgacggcaacaacaagtactacgccgacagcgtgaagggcagattcaccatcagcagagagaacagcaagaacaccctgtacctgcagatgaacagcctgagaaccgacgacaccgccgtgtactactgcgccaaggacctgggcgagagcgagaccgaggagtggcccagcgactactacgacttcggcagagactaccccggccaggaccccagaggcgtggtgggcaccttcgacatctggggccacggcaccatggtgaccgtgagcagc

SEQ ID NO: 32905 - RNA, 432 nt, synthetic construct
  misc_feature 1..432: note = derived and/or modified sequence opt4 from anti-HIV_cap256-038-002181_VR-Chain
  source 1..432: mol_type = other RNA
gaggtgcagctggtggagagcggcggcggcctggtgcagcccggcagaagcctgagactgagctgcgccgccagcggcttcaccttcgaggactacgccatgcactgggtgagacaggcccccggcaagggcctggagtgggtggccgtgatcagctacgacggcagcaacaagtactacgtggacagcgtgaagggcagattcaccatcagcagagacaacagcaagaacaccctgtacctgcagatgaacagcctgagagccgaggacaccgccgtgtactactgcgccaaggacctgggcgagagcgagaacgaggagtgggccaccgactactacgacttcagcatcggctaccccggccaggaccccagaggcgtggtgggcatcttcgacatctggggccagggcaccatggtgaccgtgagcagc

SEQ ID NO: 32906 - RNA, 432 nt, synthetic construct
  misc_feature 1..432: note = derived and/or modified sequence opt4 from anti-HIV_cap256-038-001902_VR-Chain
  source 1..432: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagctacgacggcaacaacaagtactacgccgacagcgtgaagggcagattcaccatcagcagagagaacagcgagaacaccctgtacctgcagatgaacagcctgagagccgacgacaccgccgtgtactactgcgccaaggacctgggcgagagcgagaacgaggagtgggccagcgactactacgacttcggcagagactaccccggccaggacaccagaggcgtggtgggcaccttcgacatctggggccacggcaccatggtgaccgtgagcagc

SEQ ID NO: 32907 - RNA, 432 nt, synthetic construct
  misc_feature 1..432: note = derived and/or modified sequence opt4 from anti-HIV_cap256-038-000976_VR-Chain
  source 1..432: mol_type = other RNA
caggtgcagctggtggagagcggcggcggcgtggtgcagcccggcagaagcctgagactgagctgcgccgccagcggcttcaccttcagcagcttcggcatgcactgggtgagacaggcccccggcaagggcctggagtgggtggccgtgatcagcgacgacggcaacaacaagtactacgccgacagcgtgaagggcagattcaccatcagcagagacaacagcaagaacaccctgtacctgcagatgaacagcctgagagtggaggacaccgccgtgtactactgcgtgaaggacgtgggcgagagcgagaacgaggagtgggccagcgactactacgacttcggcagagactaccccggccaggacaccagagccgtggtgggcgccttcgacatctggggccagggcaccatggtgaccgtgagcagc

SEQ ID NO: 32908 - RNA, 432 nt, synthetic construct
  misc_feature 1..432: note = derived and/or modified sequence opt4 from anti-HIV_cap256-038-000384_VR-Chain
  source 1..432: mol_type = other RNA
caggtgcagctggtggagagcggcggcggcgtggtgcagcccggcaagagcctgagactgagctgcgccgccagcggcttcaccttcagcagctacgtgatgcactgggtgagacaggcccccggcaagggcctggagtgggtggccgacatcagctacgacggcagcaacaagtactacgccgacagcgtgaagggcagactgaccatcagcagagacaacagcaagaacaccctgtacctgcagatgaacagcctgagagccgaggacaccgccgtgtactactgcgtgaaggacctgggcgagagcgagaaggaggagtggcccagcgactactacgacttcggcagagactaccccggccaggacagcagaggcgtggtgggcgtgttcgacatctggggccagggcaccatggtgaccgtgagcagc

SEQ ID NO: 32909 - RNA, 321 nt, synthetic construct
  misc_feature 1..321: note = derived and/or modified sequence opt4 from anti-HIV_206-314431_VR-Chain
  source 1..321: mol_type = other RNA
cagttcgtgctgacccagccccccagcgtgagcgccgcccccggccagaacgtgaccatcagctgcagcggcccccccagccacatcgagaagaacgacgtgagctggtaccagagactgcccggcatggcccccaagatggtgatctacgagagcagaagaagacccctgggcatccccgtgagattcaccgccagcagaagcggcagcagcgccaccctggtgatcaccggcctgcagaccgccgacgaggccgactactactgcggcacctgggacggcagaatgaacttcggcaccggcaccaccgtgaccgtgctg

SEQ ID NO: 32910 - RNA, 321 nt, synthetic construct
  misc_feature 1..321: note = derived and/or modified sequence opt4 from anti-HIV_206-247594_VR-Chain
  source 1..321: mol_type = other RNA
cagagcatcctgacccagccccccagcgtgagcgccgcccccggccagaacgtgaccatcagctgcagcggcccccccagccacatcgagaagaacgacgtgagctggtaccagagattccccggcatggcccccaagatgatcatctacgagagcaagagaagacccttcggcgtgcccggcagattcagcgccagcagaagcggcaagagcgccaccctggccatcaccggcctgcagaccggcgacgaggccgactactactgcggcacctgggacggcagaatgaacttcggcaccggcaccaccgtgaccgtgctg

SEQ ID NO: 32911 - RNA, 321 nt, synthetic construct
  misc_feature 1..321: note = derived and/or modified sequence opt4 from anti-HIV_206-116890_VR-Chain
  source 1..321: mol_type = other RNA
cagagcgtgctgacccagccccccagcgtgagcgccgcccccggccagaacgtgaccatcagctgcagcggcccccccagccacatcgagaagaacgacgtgagctggtaccagcacctgcccggcgaggcccccaagatgatcatctacgagagctggagaagacccgccggcatccccgccagattcagcgccagcagaagcggcaagagcggcaccctggccatcaccggcctgcagaccggcgacgaggccgactactactgcggcacctggaacggcagaatgaacttcggcaccggcaccaccgtgaccgtgctg

SEQ ID NO: 32912 - RNA, 333 nt, synthetic construct
  misc_feature 1..333: note = derived and/or modified sequence opt4 from anti-HIV_206-072383_VR-Chain
  source 1..333: mol_type = other RNA
cagagcgtgctgacccagccccccagcgtgagcgccgcccccggccagagagtgatcatcagctgcagcggcaacaacagcaccatcggcaacaacttcgtgagctggtaccagcaggtgcccggcaccgcccccaagctgctgatctacgagaccaacagaagacccagcggcatccccgacagattcagcggcagcaagagcggcaccagcgccaccctggccatcagcggcctgcagaccggcgacgaggccgacttctactgcaccgtgtggggcgtgagaaagggcgtggccgccgtgttcggcaccggcaccagactgaccgtgctg

SEQ ID NO: 32913 - RNA, 333 nt, synthetic construct
  misc_feature 1..333: note = derived and/or modified sequence opt4 from anti-HIV_206-037527_VR-Chain
  source 1..333: mol_type = other RNA
cagagcgtgctgacccagccccccagcgtgagcgccgcccccggccagaaggtgatcatcagctgcagcggcaacaacagcaccatcggcaagatcctggtgagctggtaccagcaggtgcccggcaccgcccccaagctggtgatctacgagaccaacagaagacccagcggcatccccgacagattcagcggcagcaagagcggcaccagcgccaccctggccatcaccggcctgcagaccggcgacgaggccgactacttctgcaaggtgtggggcgtgagaaagggcgtggccgccgtgttcggcaccggcaccaaggtgaccgtgctg

SEQ ID NO: 32914 - RNA, 333 nt, synthetic construct
  misc_feature 1..333: note = derived and/or modified sequence opt4 from anti-HIV_206-009095_VR-Chain
  source 1..333: mol_type = other RNA
cagagcgtgctgacccagccccccagcgtgagcgccgcccccgcccagagagtgatcatcagctgcagcggcgacaacagcaccatcggcaacaacttcgtgagctggtaccagcaggtgcccggcgccgcccccaagctgctgatctacgagaccaacagaagacccagcggcatccccgacagattcagcggcagcaagagcggcaccaccgccaccctggccatcagcggcctgcagaccggcgacgaggccgactaccactgcaccgtgtggggcgtgagaaagggcgtggccgccgtgttcggcaccggcaccaaggtgaccgtgctg

SEQ ID NO: 32915 - RNA, 321 nt, synthetic construct
  misc_feature 1..321: note = derived and/or modified sequence opt4 from anti-HIV_176-503620_VR-Chain
  source 1..321: mol_type = other RNA
cagagcgtgctgacccagccccccagcgtgagcaccgcccccggccagaccgtgaccgtgagctgcagcggcggcaccagcaacaccggcaacaacttcgtgagctggtaccagcacctgcccggcaccgcccccaagctgctgatctacgagaacaacaagagacccctgggcgtgcccgacagattcagcggcgccaagagcggcaccagcgccaccctggccctgaccggcctgcagaccggcgacgagggcgactactactgcgccacctggagcggcagcctgaacatcggcaccggcaccaaggtgagcgtgctg

SEQ ID NO: 32916 - RNA, 321 nt, synthetic construct
  misc_feature 1..321: note = derived and/or modified sequence opt4 from anti-HIV_176-478726_VR-Chain
  source 1..321: mol_type = other RNA
cagagcgtgctgacccagccccccagcgtgagcgccgcccccggccagaacgtgaacatcagctgcagcggcccccccagccacatcgagagaaacgacgtgagctggtaccagcacctgcccggcgccgcccccaagatgatcatctacgagagctggagaagacccgccggcatccccgacagattcagcgccagcagaagcggcgccagcgccaccctggccatcaccggcctgcagaccggcgacgaggccgactactactgcggcacctggaacggcagaatgaacttcggcaccggcaccaccgtgaccgtgctg

SEQ ID NO: 32917 - RNA, 321 nt, synthetic construct
  misc_feature 1..321: note = derived and/or modified sequence opt4 from anti-HIV_176-245056_VR-Chain
  source 1..321: mol_type = other RNA
cagagcgtgctgacccagccccccagcgtgagcgccgcccccggccagaacgtgaccatcagctgcagcggcccccccagccacatcgagaagaacggcgtgagctggtaccagcagttccccggcatggcccccaagatggtgatctacgagagcaagagaagacccttcggcgtgcccgccagattcagcgccagcagaagcggcaagagcgccaccctggccatcaccggcctgcagaccggcgacgaggccgactactactgcggcacctgggacggcagaatgaacttcggcaccggcaccaccgtgaccgtgctg

SEQ ID NO: 32918 - RNA, 321 nt, synthetic construct
  misc_feature 1..321: note = derived and/or modified sequence opt4 from anti-HIV_176-164413_VR-Chain
  source 1..321: mol_type = other RNA
cagagcgtgctgacccagccccccagcgtgagcgccgcccccggccagaaggtgaccatcagctgcagcggcggcaccagcaacatcggcaacaactacgtgagctggtaccagagactgcccggcaccgcccccaagctgctgatctacgagaacaacaagagacccagcggcatccccgacagattcagcggccccaagagcggcaccagcgccaccctggccatcaccggcctgcagcccggcgacgaggccgactactactgcgccacctggagcggcagcctgaacttcggcaccggcaccaaggtgaccgtgctg

SEQ ID NO: 32919 - RNA, 333 nt, synthetic construct
  misc_feature 1..333: note = derived and/or modified sequence opt4 from anti-HIV_176-094308_VR-Chain
  source 1..333: mol_type = other RNA
cagagcgtgctgacccagccccccagcgtgagcgccgcccccggccagaaggtgatcatcagctgcagcggcaacaacagcaccatcggcaacaacttcgtgagctggtaccagcaggtgcccggcaccgcccccaagctgctggtgtacgagacctacagaagacccagcggcatccccgacagaagcagcggcagcaagagcggcaccaccgccacccaggccatcagcggcctgcagaccggcgacgaggccgactaccactgcaccgtgtggggcgtgagaaagggcgtggccgccgtgttcggcaccggcaccaaggtgaccgtgctg

SEQ ID NO: 32920 - RNA, 333 nt, synthetic construct
  misc_feature 1..333: note = derived and/or modified sequence opt4 from anti-HIV_176-065321_VR-Chain
  source 1..333: mol_type = other RNA
cagagcgtgctgacccagccccccagcgtgagcgccgcccccggcagaagagtgatcatcagctgcagcggcaacaacagcaccatcggcaacaacttcgtgagctggtaccagcaggtgcccggcaccgcccccaagctgctggtgtacgagaccaacagaagacccagcggcatccccgacagattcagcggcagcaagagcggcaccagcgccaccctggccatcagcggcctgcagaccggcgacgaggccgactactactgcaccgtgtggggcgtgagaaagggcgtggccgccgtgttcggcaccggcaccaaggtgaccgtgctg

SEQ ID NO: 32921 - RNA, 324 nt, synthetic construct
  misc_feature 1..324: note = derived and/or modified sequence opt4 from anti-HIV_119-099719_VR-Chain
  source 1..324: mol_type = other RNA
cagagcgtgctgacccagccccccagcgtgagcgccgcccccggccagaaggtgaccatcagctgcagcggcagcaacagctacatcggcaacaagtacatcagctggtaccagcagttccccggcaccgcccccaagctgctgatctacgagaacaacaagagacccagcggcgtgcccgacagattcagcgccagcaagagcgccaccagcgccaccctggccatcaccggcctgcacaccggcgacgaggccgactactactgcgagacctgcgacggcagcggcggcgtgttcggcaccggcaccaaggtgaccgtgctg

SEQ ID NO: 32922 - RNA, 327 nt, synthetic construct
  misc_feature 1..327: note = derived and/or modified sequence opt4 from anti-HIV_119-099536_VR-Chain
  source 1..327: mol_type = other RNA
gagctgacccagccccccagcgtgagcgccgccagcggccagaacgtgaacatcagctgcagcggcggcagcagcaacatcggcagcaactacgtgagctggtaccagcagttccccggcaccgcccccaagctgctgatctacgagaccaacaagagacccagcggcatccccgacagattcagcggcagcaagagcggcgccagcgccaccctggccatcaccggcctgcagaccggcgacgaggccgactactactgcgccacctgggccgacagcctgaacagcgccagagtgttcggcaccggcaccaaggtgaccgtgctg

SEQ ID NO: 32923 - RNA, 333 nt, synthetic construct
  misc_feature 1..333: note = derived and/or modified sequence opt4 from anti-HIV_119-098907_VR-Chain
  source 1..333: mol_type = other RNA
cagagcgtgctgacccagccccccagcgtgagcgccacccccggccagaaggtgaccatcagctgcagcggcagcaacagcaacatcggcgacaagtacgtgagctggtaccagcacttccccggcaccgcccccaagctgctggtgtacgagacctacagaagacccagcggcatccccgacagattcagcggcagcaagagcggcaccagcgccaccctggccatcaccggcctgcagaccggcgacgaggccgactactactgcaccatctggggcgtgagaaagggcgtgggcgccgtgttcggcaccggcaccaaggtgatcgtgctg

SEQ ID NO: 32924 - RNA, 324 nt, synthetic construct
  misc_feature 1..324: note = derived and/or modified sequence opt4 from anti-HIV_119-098555_VR-Chain
  source 1..324: mol_type = other RNA
cagagcgtgctgacccagccccccagcgtgagcgccgcccccggccagaacgtgaccatcagctgcagcggcagcgccagcaacatcggcaagaacttcgtgagctggtaccagcagctgcccggcaccgcccccaagctgctgatctacggcagcaacaacagacccagcggcgtgcccgacagattcagcggcagcaagagcggcaccagcgccagcctggccatcaccggcctgcagaccggcgacgaggccgactactactgcgagacctgggacggcagcggcgccgtgttcggcaccggcaccaaggtgaccgtgctg

SEQ ID NO: 32925 - RNA, 324 nt, synthetic construct
  misc_feature 1..324: note = derived and/or modified sequence opt4 from anti-HIV_119-097828_VR-Chain
  source 1..324: mol_type = other RNA
cagagcgtgctgacccagccccccagcgtgagcgccgcccccggccagaaggtgaccatcagctgcagcggcagcagcagcaacatcggcaagaactacgtgagctggtaccagctgctgcccggcaccgcccccagactggtgatctacgagaacgacgagagacccagcggcacccccgacagattcagcggcagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32926 - RNA, 324 nt, synthetic construct
  misc_feature 1..324: note = derived and/or modified sequence opt4 from anti-HIV_119-096480_VR-Chain
  source 1..324: mol_type = other RNA
cagagcgtgctgacccagccccccagcgtgagcggcgcccccggccagagaatcaccatcagctgcagcggcagcaccagcaacatcggccagaactacgtgagctggtaccagcagctgcccggcaccgcccccaagctgctgatcagcgacaacaacagaagacccagctggacccccgacagattcagcggcagcaagagcggcaccagcgccaccctggccatcaccggcctgcagaccggcgacgaggccgactactactgcgagacctgggacggcagcggcggcgtgttcggccccggcaccagagtgaccgtgctg

SEQ ID NO: 32927 - RNA, 324 nt, synthetic construct
  misc_feature 1..324: note = derived and/or modified sequence opt4 from anti-HIV_119-095664_VR-Chain
  source 1..324: mol_type = other RNA
cagagcgtgctgacccagccccccagcgtgagcgccgcccccggccagaaggtgaccatcagctgcagcggcggcgccgccaacatcggcaagaacagcgtgagctggtaccagcagctgcccggcaccgcccccaagctgctgatctacgacaacaacagaagacccagcggcacccccgacagattcagcggcagcaagagcggcaccagcgccaccctggccatcagcggcctgcagaccggcgacgaggccgactactactgcgagacctggcacggcagcggcggcgtgttcggcaccggcaccaaggtgaccgtgctg

SEQ ID NO: 32928 - RNA, 321 nt, synthetic construct
  misc_feature 1..321: note = derived and/or modified sequence opt4 from anti-HIV_119-095212_VR-Chain
  source 1..321: mol_type = other RNA
cagagcgtgctgacccagccccccagcgtgagcgccgcccccggccagaaggtgaccatcagctgcagcggcagcaccagcaacatcggcaagagcgacgtgttctggtaccagcagctgcccggcaccgcccccaagctgctgatcagcgagaccagcagaagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 32929 - RNA, 333 nt, synthetic construct
  misc_feature 1..333: note = derived and/or modified sequence opt4 from anti-HIV_119-094773_VR-Chain
  source 1..333: mol_type = other RNA
cagagcgtgctgacccagagccccaccgtgagcgccgcccccggccagaccgtgaccatcagctgcagcggcggcaccagcaacgtgggcaagaacttcgtgagctggtaccagcagttccccagaaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 32930 - RNA, 324 nt, synthetic construct
  misc_feature 1..324: note = derived and/or modified sequence opt4 from anti-HIV_119-094508_VR-Chain
  source 1..324: mol_type = other RNA
cagagcgtgctgacccagccccccagcgtgagcgccacccccggccagagagtgaccgtgagctgcagcggcagcagcagcaacatcggcaaccactacgtgagctggtaccagcaggtgcccggcaccgcccccaagctgctgatcagcgagaacagcagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 32931 - RNA, 324 nt, synthetic construct
  misc_feature 1..324: note = derived and/or modified sequence opt4 from anti-HIV_119-093795_VR-Chain
  source 1..324: mol_type = other RNA
cagagcgtgctgacccagccccccagcgtgagcgccgcccccggccagaaggtgaccatcagctgcagcggcagcagcagcaacatcggcaacaactacgtgagctggtaccagtacctgcccggcaccgcccccaagctgctgatcagcgagaacaacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 32932 - RNA, 321 nt, synthetic construct
  misc_feature 1..321: note = derived and/or modified sequence opt4 from anti-HIV_119-093732_VR-Chain
  source 1..321: mol_type = other RNA
cagagcgtgctgacccagccccccagcgtgagcgccgccgccggccagaacgtgaacatcagctgcagcggcagaaagagcaacgtgggcggcaactacgtgagctggtaccagcagttccccggcaccgcccccaagctgctgatctacgaggacaacaagagacccagctggatccccgacagattcaccgccagcagaagcggcaccagcgccaccctgggcatcaccggcctgcagaccggcgacgaggccgactacttctgcagcacctggagcggcagcctgaacttcggcaccggcaccagagtgaccgtgctg

SEQ ID NO: 32933 - RNA, 333 nt, synthetic construct
  misc_feature 1..333: note = derived and/or modified sequence opt4 from anti-HIV_119-092903_VR-Chain
  source 1..333: mol_type = other RNA
cagagcgtgctgacccagccccccagcgtgagcgccgcccccagacagaaggtgaccatcagctgcagcggcagcagcagcaacatcggcaaccactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 32934 - RNA, 333 nt, synthetic construct
  misc_feature 1..333: note = derived and/or modified sequence opt4 from anti-HIV_119-092284_VR-Chain
  source 1..333: mol_type = other RNA
cagagcgtgctgacccagccccccagcgtgagcggcgcccccggccagagagtgaccatcagctgcaccggcagcagcagcaacatcggcggctacgacgtgcactggtaccagcaggtgcccggcaccgcccccaagctgctgctgtacgagaacgacagaagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 32935 - RNA, 333 nt, synthetic construct
  misc_feature 1..333: note = derived and/or modified sequence opt4 from anti-HIV_119-091586_VR-Chain
  source 1..333: mol_type = other RNA
cagagcgtgctgacccagccccccagcatgagcgccgcccccggccagagagtgaccatcagctgcagcggcaccagcagcgacatcggcagaaactacgtgagctggtaccagcagttccccggcgccgcccccaaggtgctgatctacgagaacagcaacagacccagcggcatccccgacagattcagcggcagcaagagcggcaccagcgccaccctggccatcagcggcctgcagaccggcgacgaggccgactactgctgcgccgtgtggggcgtgagaagaggcgccggcgccgtgttcggcgccggcaccaaggtgaccgtgctg

SEQ ID NO: 32936 - RNA, 333 nt, synthetic construct
  misc_feature 1..333: note = derived and/or modified sequence opt4 from anti-HIV_119-091023_VR-Chain
  source 1..333: mol_type = other RNA
cagagcgtgctgacccagccccccagcgtgagcgccgcccccggccagagagtgaccatcagctgcagcggcagcaccagcaacatcggcaacaacttcgtgagctggtaccaccacgtgcccggcaccgcccccaagctgctgatctacgacaacgtgaagagacccaccaacgtgcccgacagattcagcggcagcaagagcggcaccagcgccaccctggccatcagcggcctgcagaccggcgacgaggccgactactggtgcgccgtgtggggcgtgagaagaggcgccggcgccgtgttcggcgccggcaccaaggtgaccgtgctg

SEQ ID NO: 32937 - RNA, 333 nt, synthetic construct
  misc_feature 1..333: note = derived and/or modified sequence opt4 from anti-HIV_119-090334_VR-Chain
  source 1..333: mol_type = other RNA
cagagcgtgctgacccagccccccagcgtgagcggcgcccccggccagagagtgaccatcagctgcaccggcagcgccagcaacatcggcgacagcgacgtgcactggtaccagcagctgcccggcaccgcccccaagctgctgatcttcgacaacgacaagagacccagcggcatccccgacagattcagcggcagcaagagcggcaccagcgccaccctggccatcaccggcctgcagagcggcgacgaggccgactactactgcgccgtgtggggcgtgagacagggcgccggcgccgtgttcggcaccggcaccaaggtgaccgtgctg

SEQ ID NO: 32938 - RNA, 333 nt, synthetic construct
  misc_feature 1..333: note = derived and/or modified sequence opt4 from anti-HIV_119-088694_VR-Chain
  source 1..333: mol_type = other RNA
cagagcgtgctgacccagccccccagcgtgagcgccgcccccggccagaaggtgaccatcagctgcagcggcagcagcagcaacatccccatcaacggcgtgagctggtaccagcagttccccggcaccgcccccaagctgctggtgtacgagacctacagaagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 32939 - RNA, 333 nt, synthetic construct
  misc_feature 1..333: note = derived and/or modified sequence opt4 from anti-HIV_119-088499_VR-Chain
  source 1..333: mol_type = other RNA
cagagcgtgctgacccagccccccagcgtgagcgccgcccccggccagaaggtgaccatcagctgcagcggcagcaacagctacatcggcaacaagtacgtgagctggtaccagcagttccccggcaccgcccccaagctgctgatctacgagaccaacaagagacccagcggcatccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 32940 - RNA, 333 nt, synthetic construct
  misc_feature 1..333: note = derived and/or modified sequence opt4 from anti-HIV_119-088298_VR-Chain
  source 1..333: mol_type = other RNA
cagagcgtgctgacccagccccccagcgtgagcgccgcccccaaggagaaggtgaccatcagctgcagcggcggcaccagcaacatcggcagaaactacgtgagctggtaccagcaggtgcccggcaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctggggcggcagcctgagaaccggcggcgtgctgggcaccggcaccagagtgaccgtgctg

SEQ ID NO: 32941 - RNA, 324 nt, synthetic construct
  misc_feature 1..324: note = derived and/or modified sequence opt4 from anti-HIV_119-087488_VR-Chain
  source 1..324: mol_type = other RNA
cagagcgtgctgacccagccccccagcgtgagcgccgcccccggccagaaggtgaccatcttctgcagcggcagatacagcaacatcgagagcaactacgtgagctggtaccagcagctgcccggcaccgcccccaagctgctgatccacgagaacaacagaagacccagcggcacccccgacagattcagcggcagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32942 - RNA, 333 nt, synthetic construct
  misc_feature 1..333: note = derived and/or modified sequence opt4 from anti-HIV_119-087423_VR-Chain
  source 1..333: mol_type = other RNA
cagagcgtgctgacccagccccccagcgtgagcgccgcccccggccagaaggtgaccatcagctgcagcgccagcagcagcaacatcggcaacaactacgtgagctggtaccagcagctgcccgccaccgcccccaagctgctgatctacgacaccgacaagagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 32943 - RNA, 324 nt, synthetic construct
  misc_feature 1..324: note = derived and/or modified sequence opt4 from anti-HIV_119-087371_VR-Chain
  source 1..324: mol_type = other RNA
cagagcgtgctgacccagccccccagcctgagcgccgcccccggccagagagtgaccatcagctgcagcggcggcgccagcaacatcggcaagaacagcgtgagctggtacgtgcaggtgcccggcaccgcccccaagctgctgatctacgagaacaaccagagacccagcggcatcagcgacagattcagcggcagcaagagcggcagcagcgccaccctgggcatcaccggcctgcagaccgccgacgaggccgactactactgcgagacctgggacggcagcggcggcgtgttcggcaccggcaccaaggtgaccgtgctg

SEQ ID NO: 32944 - RNA, 321 nt, synthetic construct
  misc_feature 1..321: note = derived and/or modified sequence opt4 from anti-HIV_119-087279_VR-Chain
  source 1..321: mol_type = other RNA
cagagcgtgctgacccagccccccagcgtgagcgccgcccccggccagaaggtgaccatcagctgcagcggcagcagcagcaacatcggcaagaactacgtgagctggtaccagcagttccccggcaccgcccccaagctgctgatgtacgagaacaacaagagacccagcggcgtgcccgacagattcagcggcagcaagagcggcaccagcgccaccctggacatcagcggcctgcagaccggcgacgaggccgactactactgcagcacctggagcggcagcctgaacttcggcaccggcaccagagtgaccgtgctg

SEQ ID NO: 32945 - RNA, 324 nt, synthetic construct
  misc_feature 1..324: note = derived and/or modified sequence opt4 from anti-HIV_119-087146_VR-Chain
  source 1..324: mol_type = other RNA
cagagcgtgctgacccagccccccagcgtgagcgccgcccccggccagaaggtgaccatcagctgcagcggcagcagcagcaacatcggcaagaacagcgtgagctggtaccagcagttccccggcaccgcccccaagctgctgatctacgagaacaacaagagacccagcggcatccccgacagattcagcggcagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32946 - RNA, 324 nt, synthetic construct
  misc_feature 1..324: note = derived and/or modified sequence opt4 from anti-HIV_119-087048_VR-Chain
  source 1..324: mol_type = other RNA
cagttcgtgctgacccagccccccagcgtgagcgccgcccccagacagaaggtgatcatcagctgcagcggcagcagcagcaacatcggcaagaactacgtgagctggtaccagcagctgcccggcaccgcccccaagctgctgatctacgacaacgacaagagacccagcggcatcagcgacagattcagcgccagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32947 - RNA, 321 nt, synthetic construct
  misc_feature 1..321: note = derived and/or modified sequence opt4 from anti-HIV_119-085802_VR-Chain
  source 1..321: mol_type = other RNA
cagagcatcctgacccagccccccagcgtgagcgccgcccccggccagagagtgaccatcccctgcttcggcggccacagcaacatcggcagcaactacgtgagctggtaccagcacctgcccggcaccgcccccaagctgctgatcttcgagaacaacaagagacccagcggcatccccgacagattcagcggcgccaagagcggcaccagcgccaccctggccatcaccggcctgcagaccggcgacgaggccgactacttctgcgccacctggagcggcggcctgaacttcggcaccggcaccaaggtgaccgtgctg

SEQ ID NO: 32948 - RNA, 324 nt, synthetic construct
  misc_feature 1..324: note = derived and/or modified sequence opt4 from anti-HIV_119-085784_VR-Chain
  source 1..324: mol_type = other RNA
cagagcttcctgacccagccccccagcgtgagcgccgcccccggccagaaggtgaccatcagctgcagcggcagcaacagcaacatcggcaacaactacgtgagctggtaccagtacctgcccggcaccgcccccaagctgctgatctacgagaacgacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 32949 - RNA, 333 nt, synthetic construct
  misc_feature 1..333: note = derived and/or modified sequence opt4 from anti-HIV_119-085370_VR-Chain
  source 1..333: mol_type = other RNA
cagagcgtgctgacccagccccccagcgtgagcgccgcccccggccagaccgtgaccatcagctgcagcggcagcagcagcaacatcggcaacacctacgtgagctggtaccagcacctgcccggcaccgcccccaagctgctgatctacgacaacaacatcagacccagcggcatccccgacagattcagcgccagcaagagcggcaccagcgccaccctggccatcaccggcctgcagaccggcgacgaggccgactactactgcgccacctgggcccccagcctgaacagcgccagagtgttcggcagcggcaccagagtggccgtgctg

SEQ ID NO: 32950 - RNA, 321 nt, synthetic construct
  misc_feature 1..321: note = derived and/or modified sequence opt4 from anti-HIV_119-085276_VR-Chain
  source 1..321: mol_type = other RNA
cagagcatcctgacccagccccccagcgtgagcgccgcccccggccagagagtgaccatcagctgcagcggcagcagcagcaacatcggcaacaactacgtgagctggtaccagcacgtgcccggcaccgcccccaagctgctgatctacgagaacaacagaagacccagcggcacccccgacagattcagcggcgccaagagcggcaccagcgccaccctggccatcaccggcctgcagaccggcgacgaggccgactacttctgcagcacctggagcggcagcctgaacttcggcaccggcaccaaggtgaccgtgctg

SEQ ID NO: 32951 - RNA, 333 nt, synthetic construct
  misc_feature 1..333: note = derived and/or modified sequence opt4 from anti-HIV_119-084885_VR-Chain
  source 1..333: mol_type = other RNA
cagagcgtgctgacccagccccccagcgtgagcgccgcccccggcgagaaggtgaccatcagctgcagcggcagcagcagcaagatcggcaacaacttcgtgagctggtaccagcaggtgcccggcaccgcccccaagctgctggtgtacgagagctacagaagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 32952 - RNA, 333 nt, synthetic construct
  misc_feature 1..333: note = derived and/or modified sequence opt4 from anti-HIV_119-084874_VR-Chain
  source 1..333: mol_type = other RNA
cagagcgtgctgacccagccccccagcgtgagcggcgcccccagacagagagtgaccatcagctgcagcggcagcgccagcaacatcggcaagaacagcgtgagctggtaccagcaggtgcccggcaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 32953 - RNA, 333 nt, synthetic construct
  misc_feature 1..333: note = derived and/or modified sequence opt4 from anti-HIV_119-084691_VR-Chain
  source 1..333: mol_type = other RNA
cagagcgtgctgacccagccccccagcgtgagcgccgcccccggccagaaggtggtgatcagctgcagcggcagcagcagcatcatcgagaagaacagcatcagctggtaccagcagggccccggcgccgcccccaagctgctgatctacgagaacgacaagagacccagcggcatccccgacagattcagcggcagcaagagcgccaccagcgccaccctggccatcgtgggcctgcagaccggcgacgaggccgactactgctgcgccgtgtggggcgtgagaagaggcgccggcgccgtgttcggcgccggcaccaaggtgaccgtgctg

SEQ ID NO: 32954 - RNA, 324 nt, synthetic construct
  misc_feature 1..324: note = derived and/or modified sequence opt4 from anti-HIV_119-083793_VR-Chain
  source 1..324: mol_type = other RNA
cagagcgtgctgacccagccccccagcgtgagcgccgcccccggccagaaggtgaccatcagctgcagcggcagcagcagcaacatcggcaagaacagcgtgagctggtaccagcagctgcccgccaccgcccccaagctgctgatctacgagagcaacaagagacccagcggcatccccgacagattcagcggcagcaagagcggcaccagcgccaccctggccatcaccggcctgcagaccggcgacgaggccgactactactgcgccacctgggacggcagagtgagcgtgatcggcaccggcaccaaggtgaccgtgctg

SEQ ID NO: 32955 - RNA, 324 nt, synthetic construct
  misc_feature 1..324: note = derived and/or modified sequence opt4 from anti-HIV_119-083163_VR-Chain
  source 1..324: mol_type = other RNA
cagagcgtgctgacccagccccccagcgtgagcggcgcccccggccagagagtgatcatcagctgcaccggcagcagcagcaacatctggggctacgacgtgcagtggtaccagcagctgcccggcaccgcccccaagctgctgctgtacgagaacgacagaagacccagcggcacccccgacagattcagcggcagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32956 - RNA, 333 nt, synthetic construct
  misc_feature 1..333: note = derived and/or modified sequence opt4 from anti-HIV_119-082331_VR-Chain
  source 1..333: mol_type = other RNA
cagagcgtgctgacccagccccccagcatcagcgccgcccccggccagaaggtgaccatcagctgcagcggcggcagcagcaacatcggcgccaactacgtgagctggtaccagcacctgcccggcaccgcccccaagctgctgatctacgagaccaacaagagacccagcggcatccccgacagattcagcggcagccagagcggcaccagcgccaccctggtgatcaccggcctgcagaccggcgacgaggccgacttctactgcggcacctggggcggcagcctgagagccggcggcgtgatcggcaccggcaccagagtgaccgtgctg

SEQ ID NO: 32957 - RNA, 324 nt, synthetic construct
  misc_feature 1..324: note = derived and/or modified sequence opt4 from anti-HIV_119-082070_VR-Chain
  source 1..324: mol_type = other RNA
cagagcgtgctgacccagccccccagcgtgagcgccgcccccggccagaaggtggtgatcagctgcagcggcagcagcagcatcatcgagaagaacagcatcagctggtaccagcagggccccggcgccgcccccaagctgctgatctacgagaacgacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 32958 - RNA, 333 nt, synthetic construct
  misc_feature 1..333: note = derived and/or modified sequence opt4 from anti-HIV_119-081512_VR-Chain
  source 1..333: mol_type = other RNA
cagagcgtgctgacccagccccccagcgtgagcgccgcccccggccagaacgtgaccttcagctgcagcggcagcaacagcaacatcggcgacaactacgtgagctggtaccagcagatccccggcaccgcccccaagctggtgatctacgacaacaacaagagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 32959 - RNA, 333 nt, synthetic construct
  misc_feature 1..333: note = derived and/or modified sequence opt4 from anti-HIV_119-080816_VR-Chain
  source 1..333: mol_type = other RNA
cagctggtgctgacccagccccccagcgccagcggcacccccggccagagagtgaccatcagctgcagcggcagcagcagcaacatcggcagcaacttcgtgagctggtaccagcagagacccggcaccgcccccaagctgctgatctacgagaccaacaagagacccagcggcatccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 32960 - RNA, 333 nt, synthetic construct
  misc_feature 1..333: note = derived and/or modified sequence opt4 from anti-HIV_119-079302_VR-Chain
  source 1..333: mol_type = other RNA
cagagcgtgctgacccagccccccagcgtgagcgccgcccccggccagaaggtgaccatcagctgcagcggcagcagcagctacatcggcaacaagtacgtgagctggtaccagcagttccccggcaccgcccccaagctgctgatctacgagaacaacaagagactgagcggcatccccgacagattcagcgccagcaagagcgccaccagcgccaccctggccatcagcggcctgcagaccggcgacgaggccgacttctactgcggcacctgggacggcagcctgagaaccggcggcgtgatcggcaccggcaccagagtgaccgtgctg

SEQ ID NO: 32961 - RNA, 327 nt, synthetic construct
  misc_feature 1..327: note = derived and/or modified sequence opt4 from anti-HIV_119-079292_VR-Chain
  source 1..327: mol_type = other RNA
cagagcgtgctgacccagccccccagcgtgagcgccgcccccggccagaaggtgaccatcagctgcagcggcagcaacagcaacatcggcaacaactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccaactactactgcggcacctgggacaccagcctgagcggcgtgttcggcaccggcaccgaggtgatcgtgctg

SEQ ID NO: 32962 - RNA, 321 nt, synthetic construct
  misc_feature 1..321: note = derived and/or modified sequence opt4 from anti-HIV_119-079289_VR-Chain
  source 1..321: mol_type = other RNA
cagagcgccctgacccagccccccagcgtgagcgccgcccccggccagagagtgaccatcagctgcagcggcaacaacagcaacatcggcaacaacttcgtgagctggtaccagctgctgcccggcaccgcccccaagctgctgatctacgagaacaacaagagaagcagcggcatccccgacagattcagcggcagcaagagcggcaccagcgccaccctgggcatcaccggcctgcagaccggcgacgaggccgactacttctgcagcacctggagcggcagcctgaacttcggcaccggcaccagagtgaccgtgctg

SEQ ID NO: 32963 - RNA, 324 nt, synthetic construct
  misc_feature 1..324: note = derived and/or modified sequence opt4 from anti-HIV_119-078935_VR-Chain
  source 1..324: mol_type = other RNA
cagagcgtgctgacccagccccccagcgtgagcgccgcccccggccagagagtgaccatcagctgcagcggcaccagcgccaacatcgagaactactacgtgagctggtaccagcagctgcccggcaccgcccccaagctgatcatctacgacgacaacaagagacccagcggcatcccccagagattcagcggcagcaagagcggcaccagcgccaccctgggcatcaccggcctgcagaccggcgacgaggccgagtactactgcgagacctgggacggcagcggcggcgtgttcggcaccggcaccaaggtgaccgtgctg

SEQ ID NO: 32964 - RNA, 324 nt, synthetic construct
  misc_feature 1..324: note = derived and/or modified sequence opt4 from anti-HIV_119-078702_VR-Chain
  source 1..324: mol_type = other RNA
cagagcgtgctgacccagccccccagcgtgagcgccgcccccggccagaaggtgaccatcagctgcagcggcagcagcagcgtgttcggcaagaactacgtgagctggtaccagcacctgcccggcaccgcccccaagctgctgatctacgagaacaccaagagacccagcggcatccccgacagattcagcggcagcaagagcggcaccagcgccaccctggccatcaccggcctgcagaccggcgacgaggccgactactactgcgagacctgggacggcagcggcggcgtgttcggcagcggcaccaaggtgaccgtgctg

SEQ ID NO: 32965 - RNA, 324 nt, synthetic construct
  misc_feature 1..324: note = derived and/or modified sequence opt4 from anti-HIV_119-078593_VR-Chain
  source 1..324: mol_type = other RNA
cagagcttcctgacccagccccccagcgtgagcgccgcccccggccagaaggtgaccatcagctgcagcggcagcaacagcaacatcggcaacaactacgtgagctggtaccagcaggtgcccggcaccgcccccaagctgctgatctacgagaacaacaagagacccagcggcatccccgacagattcagcggcagcaagagcggcaccagcgccaccctggtgatcaccggcctgcacaccggcgacgaggccgactactactgcgagacctgggacggcagcggcggcgtgttcggcaccggcagcaacgtgaccctgctg

SEQ ID NO: 32966 - RNA, 333 nt, synthetic construct
  misc_feature 1..333: note = derived and/or modified sequence opt4 from anti-HIV_119-077708_VR-Chain
  source 1..333: mol_type = other RNA
cagagcgtgctgacccagccccccagcctgagcgccgcccccggccagaaggtgaccatcagctgcagcggcaccaccagcaacatcggcaacaactacgtgagctggtaccagcacctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcaccgtgtggggcgtgagaaagggcgtgggcgccgtgttcggcaccggcaccaaggtgaccgtgctg

SEQ ID NO: 32967 - RNA, 321 nt, synthetic construct
  misc_feature 1..321: note = derived and/or modified sequence opt4 from anti-HIV_119-076904_VR-Chain
  source 1..321: mol_type = other RNA
cagagcgtgctgacccagccccccagcgtgagcgccgcccccggccagaaggtgaccatcagctgcagcagaagcagcagccacatcgagaacagctacgtgagctggtaccagcacctgcccggcaccgcccccaagctgctgatctacgagaacaacaagagacccagcggcatccccgacagattcagcggcagcaagagcggcaccagcgccaccctgggcatcagcggcctgcagaccggcgacgaggccgactacttctgcagcacctggagcggcagcctgaacttcggcaccggcaccagagtgaccgtgctg

SEQ ID NO: 32968 - RNA, 324 nt, synthetic construct
  misc_feature 1..324: note = derived and/or modified sequence opt4 from anti-HIV_119-075862_VR-Chain
  source 1..324: mol_type = other RNA
cagagcgtgctgacccagccccccagcatcagcgccgcccccggccagaaggtgaccatcagctgcagcggcagcgccagcaacatcggcaagaacagcgtgagctggtaccagcagttccccggcaccgcccccaagctgctgatctacgagaacaacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 32969 - RNA, 333 nt, synthetic construct
  misc_feature 1..333: note = derived and/or modified sequence opt4 from anti-HIV_119-075465_VR-Chain
  source 1..333: mol_type = other RNA
cagagcgtgctgacccagccccccagcgtgagcgccgcccccggccagaaggtggtgatcagctgcagcggcagcagcagcatcatcggcaacaactacgtgagctggtaccagcagctgcccggcaccgcccccaagctgctgatctacgagaacaacagaagacccagcggcatccccgacagattcagcggcagcaagagcggcaccagcgccaccctggccatcagcggcctgcagaccggcgacgaggccgactactgctgcgccgtgtggggcgtgagaagaggcgccggcgccgtgttcggcgccggcaccaaggtgaccgtgctg

SEQ ID NO: 32970 - RNA, 330 nt, synthetic construct
  misc_feature 1..330: note = derived and/or modified sequence opt4 from anti-HIV_119-074822_VR-Chain
  source 1..330: mol_type = other RNA
agcgtgctgacccagccccccagcgtgagcgccgcccccggccagaacatcaccatcagctgcagcggcggcagcagcaacatcgccaagaactacatcagctggtaccagcacctgcccggcaccgcccccaagatcgtgatctacgacaacgacaagagacccctgggcatccccgacagattcagcgccagcaagagcggcaccagcgccaccctgggcatcaccggcctgcagaccggcgacgaggccgactactactgcgccgtgtggggcgtgagaagaggcgtgggcgccgtgttcggcgccggcaccaaggtgatcgtgctg

SEQ ID NO: 32971 - RNA, 333 nt, synthetic construct
  misc_feature 1..333: note = derived and/or modified sequence opt4 from anti-HIV_119-074629_VR-Chain
  source 1..333: mol_type = other RNA
cagagcgtgctgacccagccccccagcgagagcgccgcccccggccagaaggtgaccatcagctgcagcggcggcaccagcaacatcggcaacaactacgtgagctggtacagaagactgcccggcaccgcccccaagctgctgatctacgagaacaacagaagacccagcggcatccccgacagattcagcggcagcaagagcggcaccagcgccaccctggccatcagcggcctgcagaccggcgacgaggccgactactgctgcgccgtgtggggcgtgagaagaggcgccggcgccgtgttcggcgccggcaccaaggtgaccgtgctg

SEQ ID NO: 32972 - RNA, 324 nt, synthetic construct
  misc_feature 1..324: note = derived and/or modified sequence opt4 from anti-HIV_119-074500_VR-Chain
  source 1..324: mol_type = other RNA
cagagcgtgctgacccagccccccagcgtgagcgccgcccccggccagaaggtgaccatgagctgcagcggcagcagcagcaacatcggcaacaactacgtgagctggtaccagtacctgcccggcaccgcccccaagctgctgatctacgagaacgacagaagacccagcggcatccccgacagattcagcgccagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 32973 - RNA, 333 nt, synthetic construct
  misc_feature 1..333: note = derived and/or modified sequence opt4 from anti-HIV_119-073911_VR-Chain
  source 1..333: mol_type = other RNA
cagagcgtgctgacccagccccccagcgtgagcgccgcccccggccagagagtgaccatcagctgcagcggcagcagcagcaacatcgagaacaactacgtgagctggtaccagcacctgcccggcaccgcccccaagctgctggtgtacgacgacaacaagagacccagcggcatcccccacagattcagcgccagcaagagcggcaccagcgccaccctggccatcaccggcctgcagaccggcgacgaggccgactactactgcaccctgtggggcgtgagaaagggcgtgggcgccgtgttcggcaccggcaccaaggtgaccgtgctg

SEQ ID NO: 32974 - RNA, 324 nt, synthetic construct
  misc_feature 1..324: note = derived and/or modified sequence opt4 from anti-HIV_119-072765_VR-Chain
  source 1..324: mol_type = other RNA
cagagcgtgctgacccagccccccagcgtgagcgccgcccccggccagaaggtgaccatcagctgcagcggcaacagcagcaacatcggcaacaacttcgtgagctggtaccagcaggtgcccggcaccgcccccaagctgctggtgtacgagacctacagaagacccagcggcacccccgacagattcagcggcagcaagagcggcaccagcgccaccctggccatcagcggcctgcagaccggcgacgaggccgactactactgcggcacctgggacggcagcggcggcgtgttcggcaccggcaccaaggtgaccgtgctg

SEQ ID NO: 32975 - RNA, 333 nt, synthetic construct
  misc_feature 1..333: note = derived and/or modified sequence opt4 from anti-HIV_119-072313_VR-Chain
  source 1..333: mol_type = other RNA
cagttcgtgctgacccagccccccagcgtgagcgccgcccccggccagaaggtgaccatcagctgcagcgccagcagcagcatcatcggcaagaactacgtgagctggtaccagcagttccccggcaccgcccccaagctgctgatctacgaggacaacaagagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 32976 - RNA, 333 nt, synthetic construct
  misc_feature 1..333: note = derived and/or modified sequence opt4 from anti-HIV_119-072280_VR-Chain
  source 1..333: mol_type = other RNA
cagagcgtgctgacccagccccccagcgtgagcgccgcccccggccagaaggtgagcatcagctgcagcggcagcgacagcaacctgggcgacaactacgtgagctggtaccagcagttccccggcaccgcccccaagctgctgatccacgacaacaacaagagacccagcggcacccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 32977 - RNA, 333 nt, synthetic construct
  misc_feature 1..333: note = derived and/or modified sequence opt4 from anti-HIV_119-071693_VR-Chain
  source 1..333: mol_type = other RNA
cagagcgtgctgacccagccccccagcgtgagcgccgcccccggccagaaggtggtgatcagctgcagcggcagcagcagcatcatcgagaagaacagcatcagctggtaccagcagggccccggcgccgcccccaagctgctgatctacgagaacgacaagagacccagcggcatccccgacagattcagcggcagcaagagcggcaccagcgccaccctggccatcaccggcctgcagaccggcgacgaggccgactactactgcaccatctggggcgtgagaaagggcgtgggcgccgtgttcggcaccggcaccaaggtgaccgtgctg

SEQ ID NO: 32978 - RNA, 321 nt, synthetic construct
  misc_feature 1..321: note = derived and/or modified sequence opt4 from anti-HIV_119-071353_VR-Chain
  source 1..321: mol_type = other RNA
cagagcgtgctgacccagccccccagcgccagcgccgcccccggccagaaggtgaccatcagctgcagcggcagcaacagcaacatcggcaacaacttcgtgagctggtaccagctgttccccggcaccgcccccaagctgctgatcttcgagaacaacaagagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 32979 - RNA, 324 nt, synthetic construct
  misc_feature 1..324: note = derived and/or modified sequence opt4 from anti-HIV_119-069711_VR-Chain
  source 1..324: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaacaacaacagacccagcggcgtgcccgacagattcagcggcagcaagagcggcaccagcgccaccctggccatcaccggcctgcagaccggcgacgaggccgactactactgcgagacctgggacgacagcggcggcgtgttcggcaccggcaccaaggtgaccgtgctg

SEQ ID NO: 32980 - RNA, 333 nt, synthetic construct
  misc_feature 1..333: note = derived and/or modified sequence opt4 from anti-HIV_119-069061_VR-Chain
  source 1..333: mol_type = other RNA
cagagcgtgctgacccagccccccagcgtgagcgccgcccccggccagaaggtgaccatcagctgcagcggcagcagcagcaacatcggcagcaactacgtgagctggtaccagcagctgcccggcaccgcccccaagctgctggtgtacgacaacaacgagagacccagcggcatccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 32981 - RNA, 324 nt, synthetic construct
  misc_feature 1..324: note = derived and/or modified sequence opt4 from anti-HIV_119-068202_VR-Chain
  source 1..324: mol_type = other RNA
cagagcgtgctgacccaggagcccagcgtgagcggcgcccccggccagagagtgaccatcagctgcaccggcagcaacagcaacatcggcggccacgacgtgcactggtaccagcagctgcccggcaccgcccccaagctgctgatctacgacaacgacaagagacccagcggcatccccgacagattcagcggcagcaagagcgacaccagcgccagcctgggcatcaccggcctgcagaccggcgacgaggccgactactactgcgagacctgggacggcagcggcggcgtgttcggcaccggcaccaaggtgaccgtgctg

SEQ ID NO: 32982 - RNA, 324 nt, synthetic construct
  misc_feature 1..324: note = derived and/or modified sequence opt4 from anti-HIV_119-068063_VR-Chain
  source 1..324: mol_type = other RNA
cagagcgccctgacccagccccccagcgccagcggcagcctgggccagagcgtgaccatcagctgcaccggcaccagaagcgacgtgggcaactactacgtgagctggtaccagcagctgcccggcaccgcccccaagctgctgatcagcgagaacaacagaagacccagcggcacccccgacagattcagcggcagcaagagcggcaccagcgccaccctggccatcagcggcctgcagaccggcgacgaggccgactactactgcggcacctgggacggcagcggcggcgtgttcggcaccggcaccaaggtgaccgtgctg

SEQ ID NO: 32983 - RNA, 333 nt, synthetic construct
  misc_feature 1..333: note = derived and/or modified sequence opt4 from anti-HIV_119-067980_VR-Chain
  source 1..333: mol_type = other RNA
cagagcgtgctgacccagccccccagcgtgagcgccgcccccggccagaaggtgaccatcagctgcagcggcaacagcagcaacatcggcaacaacttcgtgagctggtaccagcaggtgcccggcaccgcccccaagctgctggtgtacgagacctacagaagacccagcggcatccccgacagattcagcggcagcaagagcggcaccagcgccaccctggccatcaccggcctgcagaccggcgacgaggccgactaccactgcgccatctggggcgtgagaaagggcgtgggcgccgtgttcggcaccggcaccaaggtgaccgtggtg

SEQ ID NO: 32984 - RNA, 324 nt, synthetic construct
  misc_feature 1..324: note = derived and/or modified sequence opt4 from anti-HIV_119-067866_VR-Chain
  source 1..324: mol_type = other RNA
cagagcgtgctgacccagccccccagcgtgagcgccgcccccggccagaaggtgaccatcagctgcagcggcagcaccagcaccatcggcaacaactacgtgagctggtaccagcacctgcccggcaccgcccccaagctgctgatctacgacaacaacaagagacccgccggcatccccgacagattcaccgccagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32985 - RNA, 321 nt, synthetic construct
  misc_feature 1..321: note = derived and/or modified sequence opt4 from anti-HIV_119-067756_VR-Chain
  source 1..321: mol_type = other RNA
cagagcgtgctgacccagccccccagcgtgagcgccgcccccggccagaaggtggtgatcagctgcagcggcagcaccagcaacatcggcaagaacttcgtgagctggtaccagcagctgcccggcaccgcccccaagctgctgatctacgagaacagcagaagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 32986 - RNA, 321 nt, synthetic construct
  misc_feature 1..321: note = derived and/or modified sequence opt4 from anti-HIV_119-066859_VR-Chain
  source 1..321: mol_type = other RNA
cagagcgtgctgacccagccccccagcgtgagcgccgcccccggccagaaggtgaccatcacctgcagcggcagcgccagcaacatcgagaacaactacgtgagctggtaccagcagttccccggccccgcccccaagctgctgatctacgagaacgacaagagacccagcggcatccccgacagattcagcggcagcgccagcggcaccagcgccaccctggccatcaccggcctgcagaccggcgacgaggccgactacttctgcagcacctggagcggcagcctgaacttcggcaccggcaccagagtgaccgtgctg

SEQ ID NO: 32987 - RNA, 333 nt, synthetic construct
  misc_feature 1..333: note = derived and/or modified sequence opt4 from anti-HIV_119-065821_VR-Chain
  source 1..333: mol_type = other RNA
cagagcgtgctgacccagccccccagcgtgagcgccacccccggccagagagtgaccgtgagctgcagcggcagcagcagcaacatcggcaaccactacgtgagctggtaccagcaggtgcccggcaccgcccccaagctgctgatctacgacaacagcaacagacccagcggcatccccgacagattcagcggcagcaagagcggcaccagcgccaccctgggcatcaccggcctgcagaccggcgacgaggccgactactactgcaccgtgtggggcgtgagaaagggcgtgggcgccgtgttcggcaccggcaccaaggtgaccgtgctg

SEQ ID NO: 32988 - RNA, 333 nt, synthetic construct
  misc_feature 1..333: note = derived and/or modified sequence opt4 from anti-HIV_119-065191_VR-Chain
  source 1..333: mol_type = other RNA
cagagcgtgctgacccagccccccagcgtgagcgccgcccccggccagaaggtgaccatcagctgcagcggcaacaacagcaacatcggcaacaactacgtgagctggtaccagcagctgcccggcaccgcccccaagctgctgatcttcgagaaccacaagagacccagcggcatccccgacagattcagcggcagcaagagcggcaccagcgccaccctgggcatcaccggcctgcagagcggcgacgaggccgactactactgcgccacctgggcccccagactgaacagcgccagagtgttcggcaccggcaccaaggtgaccgtgctg

SEQ ID NO: 32989 - RNA, 333 nt, synthetic construct
  misc_feature 1..333: note = derived and/or modified sequence opt4 from anti-HIV_119-064667_VR-Chain
  source 1..333: mol_type = other RNA
cagagcgtgctgacccagccccccagcgtgagcgccgcccccggccagaaggtgaccatcagctgcagcggcagcaacagctacatcggcaacaagtacgtgagctggtaccagcaggtgcccggcaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 32990 - RNA, 324 nt, synthetic construct
  misc_feature 1..324: note = derived and/or modified sequence opt4 from anti-HIV_119-063791_VR-Chain
  source 1..324: mol_type = other RNA
cagagcgtgctgacccagccccccagcgtgagcgccgcccccggccagaaggtgcccatcagctgcagcggcaacagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 32991 - RNA, 333 nt, synthetic construct
  misc_feature 1..333: note = derived and/or modified sequence opt4 from anti-HIV_119-062989_VR-Chain
  source 1..333: mol_type = other RNA
cagagcgtgctgacccagccccccagcgtgagcgccgcccccggccagagagtgaccatcagctgcagcggcagcagcagcaacatcggcaacaacttcgtgagctggtaccagcagttccccggcaccgtgcccaagctgctgatctacgagaacaacagaagacccagcggcatccccgacagattcagcggcagcaagagcggcaccagcgccaccctggccatcaccggcctgcagaccggcgacgaggccgactactactgcgccgtgtggggcgtgagaagaggcgtgggcgccgtgttcggcgccggcaccaaggtgatcgtgctg

SEQ ID NO: 32992 - RNA, 321 nt, synthetic construct
  misc_feature 1..321: note = derived and/or modified sequence opt4 from anti-HIV_119-062286_VR-Chain
  source 1..321: mol_type = other RNA
cagagcgtgctgacccagccccccagcgtgagcgccgcccccggccagaaggtgaccatcagctgcagcggcagcgccagcaacatcggcaagaacttcgtgagctggtaccagcagctgcccggcaccgcccccaagctgctgatcagcgagaacaacagaagacccagcggcacccccgacagattcagcggcagcaagagcggcgccagcgccaccctggtgatcagcggcctgcagaccggcgacgaggccgactactactgcgccacctggagcggcagcctgagcatcggcaccggcaccaaggtgaccgtgctg

SEQ ID NO: 32993 - RNA, 321 nt, synthetic construct
  misc_feature 1..321: note = derived and/or modified sequence opt4 from anti-HIV_119-061416_VR-Chain
  source 1..321: mol_type = other RNA
cagagcgtgctgacccagccccccagcgtgagcgccgcccccggccagaaggtggtgatcagctgcagcggcagcagcagcatcttcgagaagaacagcatcagctggtaccagcagggccccggcgccgcccccaagctgctgatctacgagaacgacaagagaagaagcggcatccccgacagattcagcggcagcaagagcgccaccagcaccaccctggccatcgtgggcctgcagaccggcgacgaggccgactacttctgcagcacctggagcggcagcctgaacttcggcaccggcaccagagtgaccgtgctg

SEQ ID NO: 32994 - RNA, 321 nt, synthetic construct
  misc_feature 1..321: note = derived and/or modified sequence opt4 from anti-HIV_119-061344_VR-Chain
  source 1..321: mol_type = other RNA
cagagcgtgctgacccagccccccagcgtgagcgccgcccccggccagaaggtgaccatcagctgcagcggcagcagcagcgtgttcggcaagaactacgtgagctggtaccagcacctgcccggcaccgcccccaagctgctgatctacgagaacaacaagagacccagcggcatccccgacagattcagcggcgccaagagcggcaccgccgccaccctggccatcaccggcctgcagaccggcgacgaggccgactactactgcgccacctggagcggcagcctgaacttcggcaccggcaccaaggtgaccgtgctg

SEQ ID NO: 32995 - RNA, 324 nt, synthetic construct
  misc_feature 1..324: note = derived and/or modified sequence opt4 from anti-HIV_119-060240_VR-Chain
  source 1..324: mol_type = other RNA
cagagcgtgctgacccagccccccagcgagtacggcgcccccggccacaacgtgaccgtgagctgcagcggcaccaccagcaacatcgagaacaacttcgtgagctggtacctgatcgtgcccggcaccgcccccaagctgctgatcttcgacaacgacaagagacccagcggcatccccgacagattcagcggcagcaagagcggcaccagcgccaccctggccatcaccggcctgcagaccggcgacgaggccgactactactgcgccacctgggacggcagagtgagcgtgatcggcaccggcaccaaggtgaccgtgctg

SEQ ID NO: 32996 - RNA, 333 nt, synthetic construct
  misc_feature 1..333: note = derived and/or modified sequence opt4 from anti-HIV_119-060184_VR-Chain
  source 1..333: mol_type = other RNA
cagagcgtgctgacccagccccccagcgtgagcggcgcccccggccagagagtgaccatcagctgcagcggcagcagcagcaacatcggcagcaacaccgtgaactggtaccagcagctgcccggcaccgcccccaagctgctgatctacgacaacaacaagagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 32997 - RNA, 321 nt, synthetic construct
  misc_feature 1..321: note = derived and/or modified sequence opt4 from anti-HIV_119-058035_VR-Chain
  source 1..321: mol_type = other RNA
cagagcgtgctgacccagccccccagcgtgagcgccgcccccggccagaaggtgaccatcagctgcagcggcagcgccagcaacatcggcaagaacttcgtgagctggtaccagcagctgcccggcaccgcccccaagctgctgatctacgagaacaacagaagacccagcggcacccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 32998 - RNA, 321 nt, synthetic construct
  misc_feature 1..321: note = derived and/or modified sequence opt4 from anti-HIV_119-057858_VR-Chain
  source 1..321: mol_type = other RNA
cagagcgtgctgacccagccccccagcgtgagcgccgcccccggccagaacgtgaacatcagctgcagcggcggcagcagcaacatcggcagcaactacgtgagctggtaccagcagttccccggcaccgcccccaagctgctgatctacgagaacaacaagagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 32999 - RNA, 324 nt, synthetic construct
  misc_feature 1..324: note = derived and/or modified sequence opt4 from anti-HIV_119-057473_VR-Chain
  source 1..324: mol_type = other RNA
cagagcgtgctgacccagccccccagcgtgagcgccgcccccggccagaaggtgaccatcagctgcagcggcagcagcagcaacatcggcaacaactacgtgagctggtaccagcacctgcccggcaccgcccccaagctgctgatctacgacacctacagcagacccagcggcatccccgacagattcagcggcagcaagagcggcaccagcgccaccctggccatcaccggcctgcagaccggcgacgaggccgactactactgcggcacctgggacggcagcggcggcgtgttcggcaccggcaccaaggtgaccgtgctg

SEQ ID NO: 33000 - RNA, 321 nt, synthetic construct
  misc_feature 1..321: note = derived and/or modified sequence opt4 from anti-HIV_119-057090_VR-Chain
  source 1..321: mol_type = other RNA
cagagcgtgctgacccagccccccagcgtgagcgccgcccccggccagaccgtgaccatcagctgcagcggcagcaccagcaacatcggcaagaacgacgtgagctggtaccagcagctgcccggcaccgcccccaagctgctgatcagcgagaacaacagaagacccagcggcacccccgacagattcagcgccagcaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 33001 - RNA, 333 nt, synthetic construct
  misc_feature 1..333: note = derived and/or modified sequence opt4 from anti-HIV_119-055754_VR-Chain
  source 1..333: mol_type = other RNA
cagagcgtgctgacccagccccccagcgtgagcgccgcccccggccagaaggtgaccatcagctgcagcggcaacagcagcagcatcggcaacaacttcgtgagctggtaccagcagctgcccggcaccgcccccaagctgctggtgtacgagaactacagaagacccagcggcatccccgacagattcagcggcagcaagagcggcaccagcgccaccctggccatcgacggcctgcagacctgggacgaggccgactaccactgcgccatctggggcgtgagaaagggcgtgggcgccgtgttcggcaccggcaccaaggtgaccgtggtg

SEQ ID NO: 33002 - RNA, 324 nt, synthetic construct
  misc_feature 1..324: note = derived and/or modified sequence opt4 from anti-HIV_119-054899_VR-Chain
  source 1..324: mol_type = other RNA
cagagcgtgctgacccagccccccagcgtgagcgccgcccccggccagaaggtgaccatcagctgcagcggcagcaacagctacatcggcaacaagtacgtgagctggtaccagcagttccccggcaccgcccccaagctgctgatccacgagaacaacagaagacccagcggcacccccgacagattcagcggcagcaagagcggcaccagcgccaccctggccatcagcggcctgcagaccggcgacgaggccgactactactgcgagacctgggacggcagcggcggcgtgttcggcaccggcaccaaggtgaccgtgctg

SEQ ID NO: 33003 - RNA, 324 nt, synthetic construct
  misc_feature 1..324: note = derived and/or modified sequence opt4 from anti-HIV_119-054501_VR-Chain
  source 1..324: mol_type = other RNA
cagagcgtgctgacccagccccccagcgtgagcgccgcccccggccagaaggtgaccatcagctgcagcggcaccagcagcaacatcggcaacaactacgtgagctggtaccagcacctgcccggcaccgcccccaagctgctgatcttcgagaccaacaagagacccagcggcatccccgacagattcagcgccagcaagagcggcaccagcgccaccctggccatcaccggcctgcagaccggcgacgaggccgactactactgcgagacctgggacggcagcggcggcgtgttcggccccggcaccagagtgaccgtgctg

SEQ ID NO: 33004 - RNA, 324 nt, synthetic construct
  misc_feature 1..324: note = derived and/or modified sequence opt4 from anti-HIV_119-051867_VR-Chain
  source 1..324: mol_type = other RNA
cagagcgtgctgacccagccccccagcgtgagcgccgcccccggccagaaggtgaccatcagctgcagcggcaacagcagcaacatcggcaacaacttcatcagctggtaccagcagctgcccggcaccgcccccaagctgctgatctacgagaacgacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33005 - RNA, 324 nt, synthetic construct
  misc_feature 1..324: note = derived and/or modified sequence opt4 from anti-HIV_119-051814_VR-Chain
  source 1..324: mol_type = other RNA
cagagcgtgctgacccagccccccagcgtgagcgccgcccccggccagaaggtgaccatcagctgcagcggcagcaacagcaacatcggcaacaaggacgtgagctggtaccagcagatccccgccaccgcccccaagctgctgatctacgagaacaacaagagacccagcggcatccccgacagattcagcggcagcaagagcggcaccagcgccaccctggccatcaccggcctgcagaccggcgacgaggccgactactactgcgccacctgggacggcagagtgagcgtgatcggcaccggcaccaacgtgatcgtgctg

SEQ ID NO: 33006 - RNA, 321 nt, synthetic construct
  misc_feature 1..321: note = derived and/or modified sequence opt4 from anti-HIV_119-051567_VR-Chain
  source 1..321: mol_type = other RNA
cagagcgtgctgacccagccccccagcgtgagcgccgcccccggccagaaggtgaccatctactgcagcggcagcagaagcaacatcggcagaaactacgccagctggtaccagcagctgcccggcaccgcccccaagctgctgatcttcgacaacaacagaagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 33007 - RNA, 324 nt, synthetic construct
  misc_feature 1..324: note = derived and/or modified sequence opt4 from anti-HIV_119-051483_VR-Chain
  source 1..324: mol_type = other RNA
cagagcgtgctgacccagccccccagcgtgagcgccgcccccggccagaagctgaccatcagctgcagcggcaccagcagcaacatcggcaacaactacgtgagctggtaccagcacctgcccggcaccgcccccaagctgctgatctacgagaacaacagaagacccagcggcatccccgagagattcagcgccagcaagagcggcaccagcgccaccctgggcatcaccggcctgcagaccggcgacgaggccgactactactgcgagacctgggacgacagcggcggcgtgttcggcaccggcaccaaggtgaccgtgctg

SEQ ID NO: 33008 - RNA, 333 nt, synthetic construct
  misc_feature 1..333: note = derived and/or modified sequence opt4 from anti-HIV_119-050913_VR-Chain
  source 1..333: mol_type = other RNA
cagagcgtgctgacccagccccccagcgtgagcgccgcccccggccagaaggtgaccatcagctgcagcggcggcaccagcaacatcggcaacaactacgtgagctggtaccagcagctgcccggcaccgcccccagactgctgatctacgagaccaacaagagacccagcggcatccccgacagattcttcggcagcaagagcggcaccagcgccaccctggccatcagcggcctgcagaccggcgacgaggccgactactactgcaccgtgtggggcgtgagaaagggcgtgggcgccgtgttcggcaccggcaccaaggtgaccgtgctg

SEQ ID NO: 33009 - RNA, 333 nt, synthetic construct
  misc_feature 1..333: note = derived and/or modified sequence opt4 from anti-HIV_119-050187_VR-Chain
  source 1..333: mol_type = other RNA
cagagcgtgctgacccagccccccagcgtgagcgccgcccccggccagaaggtgaccatcagctgcagcggcagcagcagcaacatcggcaagaacagcgtgagctggtaccagcagttccccggcaccgcccccaagctgctgatctacgagaacaacaagagacccagcggcatccccgacagattcagcgacagccagagcggcaccagcgccaccctggccatcaccggcctgcagaccggcgacgaggccgactacagctgcgccacctgggccgccagcctgaacagcgccagagtgttcggcaccggcaccagagtgaccgtgctg

SEQ ID NO: 33010 - RNA, 324 nt, synthetic construct
  misc_feature 1..324: note = derived and/or modified sequence opt4 from anti-HIV_119-049069_VR-Chain
  source 1..324: mol_type = other RNA
cagagcgtgctgacccagccccccagcgtgagcgccgcccccggccagaaggtgaccatcagctgcagcggcagcaccagcaacatcggcaagagcgacgtgttctggtaccagcagctgcccggcaccgcccccaagctgctgatcagcgagaccagcagaagacccagcggcacccccgacagattcagcggcagcaagagcggcaccagcgccaccctgaccatcaccggcctgcagaccggcgacgaggccgactactactgcgaggcctgggacggcagcggcggcgtgttcggcaccggcaccaaggtgaccgtgctg

SEQ ID NO: 33011 - RNA, 333 nt, synthetic construct
  misc_feature 1..333: note = derived and/or modified sequence opt4 from anti-HIV_119-048517_VR-Chain
  source 1..333: mol_type = other RNA
cagagcgtgctgacccagccccccagcgtgagcgccgcccccggccagaaggtgaccatcagctgcagcggcagcaagttcaacatcggcaacaaggacgtgagctggtaccagcacagccccggcaccgcccccaagctgctgatctacgagaacaacaagagacccagcggcatccccgacagattcagcggcagcaagagcggcaccagcgccaccctgggcatcagcggcctgcagaccggcgacgaggccgactactgctgcgccgtgtggggcgtgagaagaggcgccggcgccgtgttcggcgccggcaccaaggtgaccgtgctg

SEQ ID NO: 33012 - RNA, 333 nt, synthetic construct
  misc_feature 1..333: note = derived and/or modified sequence opt4 from anti-HIV_119-048470_VR-Chain
  source 1..333: mol_type = other RNA
cagagcgtgctgacccagccccccagcgtgagcgccgcccccggccagaaggtgaccatcagctgcagcggcagcaccagcaacatcggcaagaacctggtgagctggtaccagcagttccccggcaccgcccccaagctgctgatctacgagaacaacagaagacccagcggcatccccgacagattcagcggcagcaagagcggcaccagcgccaccctggtgatcaccggcctgcagaccggcgacgaggccgacttctactgcggcacctggggcggcagcctgagagccggcggcgtgatcggcaccggcaccagagtgaccgtgctg

SEQ ID NO: 33013 - RNA, 282 nt, synthetic construct
  misc_feature 1..282: note = derived and/or modified sequence opt4 from anti-HIV_119-048303_VR-Chain
  source 1..282: mol_type = other RNA
agcgtgctgacccagccccccagcgtgagcgccgcccccggccagaacatcaccatcagctgcagcggcagcatcagcaacatcgccagcaacttcatcagctggtaccagcagctgcccggcaccgcccccaagatcatcatctacgacaacgaccagagacccctgggcatccccgccagattcagcggcagcaagagcggcgccagcgccaccctggtgatcaccggcctgcagaccggcgacgaggccgactactactgcggcacctgggacggcagc

SEQ ID NO: 33014 - RNA, 333 nt, synthetic construct
  misc_feature 1..333: note = derived and/or modified sequence opt4 from anti-HIV_119-048021_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaacaacaagagacccagcggcatccccgacagattcagcggcagcaagagcggcaccagcgccaccctggtgatcaccggcctgcagaccggcgacgaggccgacttctactgcggcacctgggacggcagcctgagcggcggcggcgtgatcggcaccggcaccagagtgaccgtgctg

SEQ ID NO: 33015 - RNA, 324 nt, synthetic construct
  misc_feature 1..324: note = derived and/or modified sequence opt4 from anti-HIV_119-047928_VR-Chain
  source 1..324: mol_type = other RNA
cagagcgtgctgacccagccccccagcgtgagcgccgcccccggccagaaggtgaccatcagctgcagcggcagcaacagcaacatcggcaacaactgcgtgagctggtaccagcaggtgcccggcaccgcccccaagctgctgatctacgagaacaacagaagacccagcggcatccccgacagattcagcggcagcaagagcggcaccagcgccaccctggccatcagcggcctgcagaccggcgacgaggccgactactactgcggcacctgggacggcagcggcggcgtgttcggcaccgccaccaaggtgaccgtgctg

SEQ ID NO: 33016 - RNA, 324 nt, synthetic construct
  misc_feature 1..324: note = derived and/or modified sequence opt4 from anti-HIV_119-047384_VR-Chain
  source 1..324: mol_type = other RNA
cagagcgtgctgacccagccccccagcgtgagcgccgcccccggccagaaggtgaccatcagctgcagcggcagcaacagcaacatcggcaacaaggacgtgagctggtacagacaggtgccccccaccgcccccaagctgctgatctacgagaacaacaagagacccagcggcatccccgacagattcagcggcagcaagagcggcaccagcgccaccctggccatcaccggcctgcagaccggcgacgaggccgactactactgcgccacctgggacggcagagtgagcgtgttcggcaccggcaccaaggtggccgtgctg

SEQ ID NO: 33017 - RNA, 333 nt, synthetic construct
  misc_feature 1..333: note = derived and/or modified sequence opt4 from anti-HIV_119-047145_VR-Chain
  source 1..333: mol_type = other RNA
cagagcgtgctgacccagccccccagcgtgagcgccgcccccggccagaccgtgaacatcagctgcagcggcagcaacagcaacatcggcagcaagtacgtgagctggtaccagcacttccccggcaccgcccccaagctgctgatctacgagaacaacaagagaagcagcggcatccccgacagattcagcggcagcaagagcgccaccagcgccaccctggccatcaccggcctgcagaccggcgacgaggccgactactactgcgccacctgggcccccagcctgaacagcgccagagtgttcggcaccggcaccaaggtgaccgtgctg

SEQ ID NO: 33018 - RNA, 333 nt, synthetic construct
  misc_feature 1..333: note = derived and/or modified sequence opt4 from anti-HIV_119-046752_VR-Chain
  source 1..333: mol_type = other RNA
cagagcgtgctgacccagccccccagcgtgagcgccgcccccggccagaaggtgaccatcagctgcagcggcaacagcagcagcatcggcaacaacttcgtgagctggtaccagcagctgcccggcaccgcccccaagctgctggtgtacgagaactacagaagacccagcggcatcagcgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 33019 - RNA, 324 nt, synthetic construct
  misc_feature 1..324: note = derived and/or modified sequence opt4 from anti-HIV_119-046660_VR-Chain
  source 1..324: mol_type = other RNA
cagagcgtgctgacccagccccccagcgtgagcgccgcccccggccagaaggtgaccatcagctgcagcggcagcagcagcaacatcggcaaccactacgtgagctggtaccagcagctgcccggcaccgcccccaagctgctgatctacgacaacaacaagagacccagcggcatccccgacagattcagcgccagcaagagcggcaccagcgccaccctgggcatcaccggcctgcagaccggcgacgaggccgactactactgcgccacctgggacggcagagtgagcgtgatcggcaccggcaccaaggtgaccgtggtg

SEQ ID NO: 33020 - RNA, 333 nt, synthetic construct
  misc_feature 1..333: note = derived and/or modified sequence opt4 from anti-HIV_119-046202_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctggtgtacgagaactacagaagacccagcggcatccccgacagattcagcggcagcaagagcggcaccagcgccaccctggccatcaccggcctgcagaccggcgacgaggccgactaccactgcgccatctggggcgtgagaaagggcgtgggcgccgtgttcggcaccggcaccaaggtgaccgtggtg

SEQ ID NO: 33021 - RNA, 333 nt, synthetic construct
  misc_feature 1..333: note = derived and/or modified sequence opt4 from anti-HIV_119-045790_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagtacctgcccggcaccgcccccaagctgctgttctacgaggacaacagaagacccagcggcacccccgacagattcagcggcagcaagagcggcaccagcgccaccctggccatcagcggcctgcagaccggcgacgaggccgactactactgcaccatctggggcgtgagaaagggcgtgggcgccgtgttcggcaccggcaccaaggtgaccgtgctg

SEQ ID NO: 33022 - RNA, 333 nt, synthetic construct
  misc_feature 1..333: note = derived and/or modified sequence opt4 from anti-HIV_119-044670_VR-Chain
  source 1..333: mol_type = other RNA
cagagcgtgctgacccagccccccagcgtgagcggcgcccccggcgagagagtgaccatcagctgcaccggcaacaccagcaacatcggcacctacgacgtgcagtggtaccagcacctgcccggcaccgcccccagactgctgatctaccacaacgtgaacctgcccagcggcgtgcccgacagattcagcgccagcaagagcggcaccagcgccaccctggccatcaccggcctgcagaccggcgacgaggccgactactactgcaccatctggggcgtgagaaagggcgtgggcgccgtgttcggcaccggcaccaaggtgaccgtgctg

SEQ ID NO: 33023 - RNA, 321 nt, synthetic construct
  misc_feature 1..321: note = derived and/or modified sequence opt4 from anti-HIV_119-044140_VR-Chain
  source 1..321: mol_type = other RNA
cagagcgtgctgacccagccccccagcgtgagcgccgcccccggccagaaggtgaccatcagctgcagcggcggcaccagcaacatcggcaaccacttcgtgagctggtacagacacctgcccggcaccgcccccaagctgctgatctacgagaacaacaacagacccagcggcatccccgacagattcagcggcgccaagagcggcaccagcgccaccctggccatcaccggcctgcagaccggcgacgagggcgactactactgcgccacctggagcggcagcctgaacatcggcaccggcaccaaggtgaccgtgctg

SEQ ID NO: 33024 - RNA, 333 nt, synthetic construct
  misc_feature 1..333: note = derived and/or modified sequence opt4 from anti-HIV_119-042776_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcacctgcccggcaccgcccccaagctgctgatctacgagagcgccagaagacccagcggcacccccgacagattcagcggcagcaagagcggcaccagcgccaccctggccatcaccggcctgcagaccggcgacgaggccgactactactgcaccctgtggggcgtgagaaagggcgtgggcgccgtgttcggcaccggcaccagagtgaccgtgctg

SEQ ID NO: 33025 - RNA, 333 nt, synthetic construct
  misc_feature 1..333: note = derived and/or modified sequence opt4 from anti-HIV_119-042581_VR-Chain
  source 1..333: mol_type = other RNA
cagagcgtgctgacccagccccccagcgtgagcgccgcccccggccagaaggtgaccatcagctgcagcggcagcagcagcaacatcggcaacaacttcgtgagctggtaccagcagctgcccggcaccgcccccaagctgctgatcttcgagacccacagaagacccagcggcatccccgacagattcagcggcagcaagagcggcaccagcgccaccctggccatcaccggcctgcagagcggcgacgaggccgactactactgcgccgtgtggggcgtgagacagggcgccggcgccgtgttcggcaccggcaccaaggtgaccgtgctg

SEQ ID NO: 33026 - RNA, 333 nt, synthetic construct
  misc_feature 1..333: note = derived and/or modified sequence opt4 from anti-HIV_119-040905_VR-Chain
  source 1..333: mol_type = other RNA
cagagcgtgctgacccagccccccagcgtgagcgccgcccccggccagaaggtgaccatcagctgcagcggcaacagcagcaacatcggcgacaacttcgtgagctggtaccagcagctgcccggcatcgcccccaagctgctggtgtacgagaccaacaagagacccagcggcatccccgacagattcgccggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 33027 - RNA, 321 nt, synthetic construct
  misc_feature 1..321: note = derived and/or modified sequence opt4 from anti-HIV_119-040322_VR-Chain
  source 1..321: mol_type = other RNA
cagagcgtgctgacccagccccccagcgtgagcgccgcccccggccagaaggtggtgatcagctgcagcggcagcagcagcatcatcgagaagaacagcatcagctggtaccagcagggccccggcgccgcccccaagctgctgatctacgagaacgacaagagacccagcggcatccccgacagattcagcggcagcaagagcggcaccaccggcaccctggccatcaccggcctgcagaccggcgacgaggccgactacttctgcgccacctggagcggcagactgaacatcggcaccggcaccaaggtgaccgtgctg

SEQ ID NO: 33028 - RNA, 324 nt, synthetic construct
  misc_feature 1..324: note = derived and/or modified sequence opt4 from anti-HIV_119-039892_VR-Chain
  source 1..324: mol_type = other RNA
cagagcgtgctgacccagccccccagcgtgagcgccgcccccggccagaaggtgaccatcagctgcagcggcagcaacgccaacatcggcaacaaggacgtgagctggtaccagcagctgcccgccaccgcccccaagctgctgatctacgagagcaacaagagacccagcggcatccccgacagattcagcggcagcaagagcggcaccagcgccaccctggccatcaccggcctgcagaccggcgacgaggccgactactactgcgccacctgggacggcagagtgagcggcatcggcaccggcaccaaggtgaccgtgctg

SEQ ID NO: 33029 - RNA, 324 nt, synthetic construct
  misc_feature 1..324: note = derived and/or modified sequence opt4 from anti-HIV_119-039764_VR-Chain
  source 1..324: mol_type = other RNA
cagagcgtgctgacccagccccccagcgtgagcgccgcccccggccagaaggtgaccatcagctgcagcggcagcgccagcaacatcggcaagaacttcgtgagctggtaccagcaggtgcccggcaccgcccccaagctgctgatctacgagaacaacagaagacccagcggcacccccgacagattcagcggcagcaagagcggcaccagcggcaccctggccatcagcggcctgcagaccggcgacgaggccgactactactgcgagacctgggacggcagcggcggcgtgttcggcaccggcaccaaggtgaccgtgctg

SEQ ID NO: 33030 - RNA, 333 nt, synthetic construct
  misc_feature 1..333: note = derived and/or modified sequence opt4 from anti-HIV_119-039188_VR-Chain
  source 1..333: mol_type = other RNA
cagagcgtgctgacccagccccccagcctgagcggcgcccccggccagaccgtgaccatcagctgcagcggcagcagcagcaacatcggcaacaactacgtgagctggtaccagcagctgcccggcaccgcccccaagctgctgatctacgacagcaacagaagacccagcggcatccccgacagattcagcggcagcaagagcggcaccagcgccaccctggccatcagcggcctgcagaccggcgacgaggccgactactgctgcgccgtgtggggcgtgagaagaggcgccggcgccgtgttcggcgccggcaccaaggtgaccgtgctg

SEQ ID NO: 33031 - RNA, 321 nt, synthetic construct
  misc_feature 1..321: note = derived and/or modified sequence opt4 from anti-HIV_119-039058_VR-Chain
  source 1..321: mol_type = other RNA
cagagcgtgctgacccagccccccagcgtgagcggcgcccccggccagagagtgaccatcagctgcaccggcagcagcagcaacatcggcaacaactacgtgagctggtacagaagactgcccggcaccgcccccaagctgctgatctacgagaacaacaagagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 33032 - RNA, 321 nt, synthetic construct
  misc_feature 1..321: note = derived and/or modified sequence opt4 from anti-HIV_119-038837_VR-Chain
  source 1..321: mol_type = other RNA
cagagcgtgctgacccagccccccagcgtgagcgccgcccccggccagaaggtgaccatcagctgcagcggcggcaccagcaacatcggcaacaacttcgtgagctggtaccagcacctgcccggcaccgcccccaagctgctgatcttcgagaacaacaagagacccagcggcgtgcccgacagattcagcggcgccaagagcggcaccagcgccaccctggccatcaccggcctgcagaccggcgacgagggcgactactactgcgccacctggagcggcagcctgaacatcggcaccggcaccaaggtgaccgtgctg

SEQ ID NO: 33033 - RNA, 321 nt, synthetic construct
  misc_feature 1..321: note = derived and/or modified sequence opt4 from anti-HIV_119-038396_VR-Chain
  source 1..321: mol_type = other RNA
cagagcgtgctgacccagccccccagcgtgagcgccacccccggccagaaggtgaccatcagctgcagcggcagcaacagcaacatcggcaacaagtacgtgagctggtaccagctgttccccggcaccgcccccaagctgctgatcagcgagaacaacagaagacccagcggcacccccgacagattcagcggcagcaagagcggcaccagcgccaccctggccatcaccggcctgcagaccggcgacgaggccgactactactgcgccacctggagcggcagcctgaacatcggcaccggcaccaaggtgaccgtgctg

SEQ ID NO: 33034 - RNA, 321 nt, synthetic construct
  misc_feature 1..321: note = derived and/or modified sequence opt4 from anti-HIV_119-036918_VR-Chain
  source 1..321: mol_type = other RNA
cagagcgtgctgacccagccccccagcgtgagcgccgcccccggccagaaggtgaccatcagctgcagcggcgccaccagcaacatctgggaccactacgtgagctggtacctgcaggtgcccggcaccgcccccagactgctgatctacgacaacgacaagagacccagcggcatccccgacagattcagcggcagcaagagcggcaccagcgccaccctggccatcaccggcctgcagaccggcgacgagggcgactactactgcgccacctggagcggcagcctgaacatcggcaccggcaccaaggtgaccgtgctg

SEQ ID NO: 33035 - RNA, 324 nt, synthetic construct
  misc_feature 1..324: note = derived and/or modified sequence opt4 from anti-HIV_119-036592_VR-Chain
  source 1..324: mol_type = other RNA
cagagcgtgctgacccagccccccagcgtgagcgccgcccccggccagaaggtgaccatcagctgcagcggcagcaacagcaacaccggcaacaaggacgtgagctggtaccagcaggtgcccgccaccgcccccaagctgctgatctacgagagcaacaagagacccagcggcatccccgacagattcagcggcagcaagagcggcaccagcgccaccctggccatcaccggcctgcagaccggcgacgaggccgactactactgcgccatctgggacggcagagtgagcgtgatcggcaccggcaccaaggtgaccgtgctg

SEQ ID NO: 33036 - RNA, 324 nt, synthetic construct
  misc_feature 1..324: note = derived and/or modified sequence opt4 from anti-HIV_119-036310_VR-Chain
  source 1..324: mol_type = other RNA
cagagcgtgctgacccagccccccagcgtgagcgccgcccccggccagaaggtgaccatcagctgcagcggcagcaccagcaacatcggccagaactacgtgagctggtaccagcagctgcccggcaccgcccccaagctgctgatctacgagaacaacagaagacccagcggcagccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33037 - RNA, 333 nt, synthetic construct
  misc_feature 1..333: note = derived and/or modified sequence opt4 from anti-HIV_119-035618_VR-Chain
  source 1..333: mol_type = other RNA
cagagcgtgctgacccagccccccagcgtgagcgccgcccccggccagaaggtgaccatcagctgcagcggcagcagcttcaccatcggcaacaaccacgtgagctggtaccagcagctgcccggcaccgcccccaagctgctgatcttcgagagccacaagagacccagcggcgtgcccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 33038 - RNA, 321 nt, synthetic construct
  misc_feature 1..321: note = derived and/or modified sequence opt4 from anti-HIV_119-035569_VR-Chain
  source 1..321: mol_type = other RNA
cagagcgtgctgacccagccccccagcgtgagcggcgcccccggccagaccgtgaccatcagctgcaccggcagcagcagcaacatcggcggctacgacgtgcactggtaccagcagctgcccggcaccgcccccaagctgctgatctacgagaacaacagaagacccagcggcacccccgacagattcagcggcgccaagagcggcaccagcgccaccctggccatcaccggcctgcagaccggcgacgagggcgactactactgcgccacctggagcggcagcctgaacatcggcaccggcaccaaggtgaccgtgctg

SEQ ID NO: 33039 - RNA, 324 nt, synthetic construct
  misc_feature 1..324: note = derived and/or modified sequence opt4 from anti-HIV_119-035466_VR-Chain
  source 1..324: mol_type = other RNA
cagagcgtgctgacccagccccccagcgtgagcgccgccgccggccagaacgtgaacatcagctgcagcggcaagaagagcaacatcggcaacaactacgtgagctggtaccagcagttccccggcaccgcccccaagctgctgatctacggcaacaccaacagacccagcggcatccccgacagattcagcggcagcaagagcggcaccagcgccaccctggccatcaccggcctgcagaccggcgacgacgccgactactactgcgagacctgggacggcagcggcggcgtgttcggcaccggcaccaaggtgaccgtgctg

SEQ ID NO: 33040 - RNA, 333 nt, synthetic construct
  misc_feature 1..333: note = derived and/or modified sequence opt4 from anti-HIV_119-035157_VR-Chain
  source 1..333: mol_type = other RNA
cagagcgtgctgacccagccccccagcgtgagcgccgcccccggccagaaggtgaccatcagctgcagcggcagcagcagcaacatcggcaacaacttcgtgagctggtaccagcagagacccggcaccgcccccaagctgctgatctacgagaccaacaagagacccagcggcatccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 33041 - RNA, 333 nt, synthetic construct
  misc_feature 1..333: note = derived and/or modified sequence opt4 from anti-HIV_119-035121_VR-Chain
  source 1..333: mol_type = other RNA
cagagcgtgctgacccagccccccagcgtgagcgccgcccccggccagaaggtgaccatcagctgcagcggcagcaccagctacatcggcaacaagtacgtgagctggtaccagcagttccccggcgccgcccccaagctgctgatctacgagaacaacaagagacccagcggcatccccgacagattcagcgccagcaagagcgccaccagcgccaccctggccatcaccggcctgcagaccggcgacgaggccgactactgctgcgccgtgtggggcgtgagaagaggcgccggcgccgtgttcggcgccggcaccaaggtgaccgtgctg

SEQ ID NO: 33042 - RNA, 324 nt, synthetic construct
  misc_feature 1..324: note = derived and/or modified sequence opt4 from anti-HIV_119-035046_VR-Chain
  source 1..324: mol_type = other RNA
cagagcgccctgacccagcccgccagcgtgagcggcagccccggccagagcatcaccatcagctgcaccggcaccagcagcgacgtgggctacgactacgtgagctggtacagacaggtgcccgccaccacccccaagctgctgatctacgagaacaacaagagacccagcggcatccccgacagattcagcggcagcaagagcggcaccagcgccaccctggccatcaccggcctgcagaccggcgacgaggccgactactactgcgccacctgggacggcagagtgagcgtgatcggcaccggcaccaaggtgaccgtggtg

SEQ ID NO: 33043 - RNA, 324 nt, synthetic construct
  misc_feature 1..324: note = derived and/or modified sequence opt4 from anti-HIV_119-034754_VR-Chain
  source 1..324: mol_type = other RNA
cagagcgtgctgacccagccccccagcgtgagcgccgcccccggcgagaaggtgaccatcagctgcagcggcagcagcagcaacatcggcaacaactacgtgagctggtaccagcagctgcccggcaccgtgcccaagctgctgatctacgacaacaacaagagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33044 - RNA, 324 nt, synthetic construct
  misc_feature 1..324: note = derived and/or modified sequence opt4 from anti-HIV_119-034318_VR-Chain
  source 1..324: mol_type = other RNA
cagagcgtgctgacccagccccccagcgtgagcgccgcccccggccagaagatcaccatcagctgcagcggcagcagcagcaacatcggcaacaacgacgtgagctggtaccagcagctgcccggcaccgcccccaagctgctgatctacgagaacgacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33045 - RNA, 333 nt, synthetic construct
  misc_feature 1..333: note = derived and/or modified sequence opt4 from anti-HIV_119-033780_VR-Chain
  source 1..333: mol_type = other RNA
cagagcgtgctgacccagccccccagcgtgagcgccgcccccggccagagagtgaccatcagctgcagcggcaccagcagcaacatcggcgagaactacgtgagctggtaccagcagatccccggcaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctggggcggcagcctgagaaccggcggcgtgctgggcaccggcaccagagtgaccgtgctg

SEQ ID NO: 33046 - RNA, 333 nt, synthetic construct
  misc_feature 1..333: note = derived and/or modified sequence opt4 from anti-HIV_119-033632_VR-Chain
  source 1..333: mol_type = other RNA
cagagcgtgctgacccagccccccagcgtgagcgccgcccccggccagagagtgaccatcagctgcagcggcggcagcagcaacatcggcagcaactacgtgagctggtaccagcagctgcccggcaccgcccccaagctgctgatctaccagaacaacaagagacccagcggcatccccgacagattcagcggcagcaagagcggcaccagcgccaccctgggcatcaccggcctgcagaccggcgacgaggccgactactactgcaccgtgtggggcgtgagaaagggcgtgggcgccgtgttcggcaccggcaccaaggtgaccgtgctg

SEQ ID NO: 33047 - RNA, 333 nt, synthetic construct
  misc_feature 1..333: note = derived and/or modified sequence opt4 from anti-HIV_119-033183_VR-Chain
  source 1..333: mol_type = other RNA
cagagcgtgctgacccagccccccagcgtgagcgccgcccccggccagatggtgaccatcagctgcagcggcggcgccagcaacctgggcaagaacagcgtgagctggtaccagcagctgcccggcaccgcccccaagctgctgatctacgaggacaacagaagacccagcggcacccccgacagattcagcggcagcagaagcggcaccagcgccaccctggccatcaccggcctgcagaccggcgacgaggccgactactactgcaccatctggggcgtgagaaagggcgtgggcgccgtgttcggcaccggcaccaaggtgaccgtgctg

SEQ ID NO: 33048 - RNA, 333 nt, synthetic construct
  misc_feature 1..333: note = derived and/or modified sequence opt4 from anti-HIV_119-030696_VR-Chain
  source 1..333: mol_type = other RNA
cagagcgtgctgacccagccccccagcgtgagcggcgcccccggccagatcgtgaccctgagctgcaccggcgccatgaccaacatcggcaacaacgacgtgcactggtaccagcacctgcccggcaccggccccaagctgctgatctacgagaacaacaagagacccagcggcatccccgacagattcagcggcagcaagagcggcaccagcgccaccctggtgatcaccggcctgcagaccggcgacgaggccgacttctactgcggcacctgggacggcagcctgagaaccggcggcgtgatcggcaccggcaccagagtgaccgtgctg

SEQ ID NO: 33049 - RNA, 324 nt, synthetic construct
  misc_feature 1..324: note = derived and/or modified sequence opt4 from anti-HIV_119-030059_VR-Chain
  source 1..324: mol_type = other RNA
cagagcgtgctgacccagccccccagcgtgagcgccgcccccggccagaaggtggtgatcagctgcagcggcagcagcagcatcatcgagaagaacagcatcagctggtaccagcagggccccggcgccgcccccaagctgctgatctacgagaacgacaagagacccagcggcatcagcgacagattcagcggcagcaagagcgccaccagcgccaccctggccatcaccggcctgcacaccggcgacgaggccgactactactgcgagacctgggacggcagcggcggcgtgttcggcaccggcaccaaggtgaccgtgctg

SEQ ID NO: 33050 - RNA, 333 nt, synthetic construct
  misc_feature 1..333: note = derived and/or modified sequence opt4 from anti-HIV_119-029589_VR-Chain
  source 1..333: mol_type = other RNA
cagagcgtgctgacccagccccccagcgtgagcgccgcccccggccagaaggtgaccatcagctgcagcggcaccagcagcaacatcggcaacaacttcgtgagctggtaccagctgctgcccggcaccgcccccagactgctgatctacgacaacaacaagagacccagcggcacccccgacagattcagcggcagcaagagcggcaccagcgccaccctgggcatcaccggcctgcagaccggcgacgaggccgacttctactgcggcacctgggacggcagcctgagaaccggcggcgtgatcggcaccggcaccagagtgaccgtgctg

SEQ ID NO: 33051 - RNA, 324 nt, synthetic construct
  misc_feature 1..324: note = derived and/or modified sequence opt4 from anti-HIV_119-029448_VR-Chain
  source 1..324: mol_type = other RNA
cagagcgtgctgacccagccccccagcgtgagcgccgcccccggccagaaggtgaccatcagctgcagcggcaacagcagcaacatcggcaagaacagcgtgagctggtaccaccagctgcccggcaccgcccccaagctgctgatctacgagaacgacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33052 - RNA, 333 nt, synthetic construct
  misc_feature 1..333: note = derived and/or modified sequence opt4 from anti-HIV_119-029220_VR-Chain
  source 1..333: mol_type = other RNA
cagagcgtgctgacccagccccccagcgtgagcgccgcccccggccagaaggtgaccatcagctgcagcggcagcaccagcaacatcggccagaactacgtgagctggtaccagcagctgcccggcaccgcccccaagctgctgatctacgagaacgacagaagacccagcggcatccccgacagattcagcggcagcaagagcggcaccagcgccaccctggccatcagcggcctgcagaccggcgacgaggccgactactgctgcgccgtgtggggcgtgagaagaggcgccggcgccgtgttcggccccggcaccaaggtgaccgtgctg

SEQ ID NO: 33053 - RNA, 333 nt, synthetic construct
  misc_feature 1..333: note = derived and/or modified sequence opt4 from anti-HIV_119-028317_VR-Chain
  source 1..333: mol_type = other RNA
cagagcgtgctgacccagccccccagcgtgagcgccgcccccggccagaaggtgaccatcagctgcagcggcagcagcagcaacatcggcaacgactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcaccatctggggcgtgagaaagggcgtgggcgccgtgttcggcaccggcaccaaggtgaccgtgctg

SEQ ID NO: 33054 - RNA, 324 nt, synthetic construct
  misc_feature 1..324: note = derived and/or modified sequence opt4 from anti-HIV_119-028165_VR-Chain
  source 1..324: mol_type = other RNA
cagagcgtgctgacccagccccccagcgtgagcgccgcccccggccagaccgtgaccatcagctgcagcggcatcaccagcaacatcggcaagaacgacgtgagctggtaccagcagctgcccggcaccgcccccaagctgctgatcagcgagaacaacagaagacccagcggcatccccgacagattcagcggcagcaagagcggcaccagcgccaccctggccatcaccggcctgcagaccggcgacgaggccgactactactgcgccatctgggacggcagagtgagcgtgatcggcaccggcaccaaggtgaccgtgctg

SEQ ID NO: 33055 - RNA, 324 nt, synthetic construct
  misc_feature 1..324: note = derived and/or modified sequence opt4 from anti-HIV_119-027147_VR-Chain
  source 1..324: mol_type = other RNA
cagagcgtgctgacccagccccccagcgtgagcgccgcccccggccagaccgtgaccatcagctgcagcggcagcaccagcgacatcggcaagaacgacgtgagctggtaccagcagctgcccggcatcgcccccaagctgctgatcagcgagaacaacagaagacccagcggcacccccgacagattcagcggcagcaagagcggcaccagcgccaccctggccatcaccggcctgcagaccggcgacgaggccgactactactgcgagacctgggacggcagcggcgccgtgttcggcaccggcaccaaggtgaccgtgctg

SEQ ID NO: 33056 - RNA, 333 nt, synthetic construct
  misc_feature 1..333: note = derived and/or modified sequence opt4 from anti-HIV_119-026743_VR-Chain
  source 1..333: mol_type = other RNA
cagagcgtgctgacccagccccccagcgtgagcgccgcccccggccagaacgtgaccatcagctgcagcggcagcagcagcaacatcggcaacaacttcgtgagctggtaccagcagagacccggcaccggccccaagctgctgatctacgagaccaacagaagacccagcggcatccccgacagattcagcggcagcaagagcggcaccagcgccaccctggccatcaccggcctgcagaccggcgacgaggccgactactactgcgccacctgggcccccagcctgaacagcgccagagtgttcggcaccggcaccaaggtgaccgtgctg

SEQ ID NO: 33057 - RNA, 333 nt, synthetic construct
  misc_feature 1..333: note = derived and/or modified sequence opt4 from anti-HIV_119-026508_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacatcagctggtaccaggtgctgcccggcaccgcccccaagctggtgatcttcaagaacaacgagagacccagcagagtgcccgacagattcagcggcagcaagagcggcaccagcgccaccctgggcatcaccggcctgcagctgggcgacgagggcgactactactgcggcacctgggagaccagcctgagcggcggcggcgtgttcggcaccggcaccaaggtgaccgtgctg

SEQ ID NO: 33058 - RNA, 324 nt, synthetic construct
  misc_feature 1..324: note = derived and/or modified sequence opt4 from anti-HIV_119-025683_VR-Chain
  source 1..324: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcgacagccagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33059 - RNA, 333 nt, synthetic construct
  misc_feature 1..333: note = derived and/or modified sequence opt4 from anti-HIV_119-025614_VR-Chain
  source 1..333: mol_type = other RNA
cagagcctgctgacccagccccccagcgtgagcgccgcccccggccagaacgtgatcatcagctgcagcggcagcagcagcaacatcggcaagaactacgtggcctggtaccagcaggtgcccggcaccgcccccaagatcgtggtgttcgagaccaccaacagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 33060 - RNA, 324 nt, synthetic construct
  misc_feature 1..324: note = derived and/or modified sequence opt4 from anti-HIV_119-025548_VR-Chain
  source 1..324: mol_type = other RNA
cagagcatcctgacccagccccccagcgtgagcgccgcccccggccagaaggtgaccatcagctgcagcggcagcagcagcaacatcggcaacaactacgtgagctggtaccagcacgtgcccggcaccgcccccaagctgctgatctacgagaacaacagaagacccagcggcacccccgacagattcagcggcagcaagagcggcaccagcgccaccctggccatcaccggcctgcagagcggcgacgaggccgactactactgcggcacctgggacggcagcggcggcgtgttcggcaccggcaccaaggtgaccgtgctg

SEQ ID NO: 33061 - RNA, 333 nt, synthetic construct
  misc_feature 1..333: note = derived and/or modified sequence opt4 from anti-HIV_119-025526_VR-Chain
  source 1..333: mol_type = other RNA
cagagcgtgctgacccagccccccagcgtgagcgccgcccccggccagaaggtgaccatcagctgcagcggcagcgccagcaacatcggcaagaacttcgtgagctggtaccagcagctgcccggcaccgcccccaagctgctgatctacgagaacaacagaagacccagcggcacccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 33062 - RNA, 324 nt, synthetic construct
  misc_feature 1..324: note = derived and/or modified sequence opt4 from anti-HIV_119-023552_VR-Chain
  source 1..324: mol_type = other RNA
cagagcgtgctgacccagccccccagcgtgagcgccgcccccggccagaccgtgaccatcagctgcagcggcagcaccagcaacatcggcaagaacgacgtgagctggtaccagcagctgcccggcaccgcccccaagctgctgatcagcgagaacaacagaagacccagcggcacccccgacagattcagcgccagcaagagcggcaccagcgccaccctggccatcaccggcctgcagaccggcgacgaggccgactactactgcgagacctggcacggcagcggcggcgtgttcggcaccggcaccaaggtgaccgtgctg

SEQ ID NO: 33063 - RNA, 321 nt, synthetic construct
  misc_feature 1..321: note = derived and/or modified sequence opt4 from anti-HIV_119-023092_VR-Chain
  source 1..321: mol_type = other RNA
cagagcgtgctgacccagccccccagcgtgagcgccgcccccggccagaaggtgaccatcagctgcagcggcagcaccagcgacctgggccagaccagagtgagctggtaccagcagctgcccagaagcgcccccgagctgctgatcttcgagaacaacagaagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 33064 - RNA, 324 nt, synthetic construct
  misc_feature 1..324: note = derived and/or modified sequence opt4 from anti-HIV_119-022793_VR-Chain
  source 1..324: mol_type = other RNA
cagagcgtgctgacccagccccccagcgtgagcgccgcccccggccagaaggtgaccatcagctgcagcggcggcaccagcaacatcggcaacaactacgtgagctggtacagaagactgcccggcaccgcccccaagctgctgatctacgagaacaacaagagacccagcggcatccccgacagattcagcggcgccaagagcggcaccagcgccaccctgggcatcaccggcctgcagaccggcgacgaggccgactactactgcgagacctgggacgacagcggcggcgtgttcggcaccggcaccaaggtgaccgtgctg

SEQ ID NO: 33065 - RNA, 324 nt, synthetic construct
  misc_feature 1..324: note = derived and/or modified sequence opt4 from anti-HIV_119-022395_VR-Chain
  source 1..324: mol_type = other RNA
cagagcgtgctgacccagccccccagcgtgagcgccgcccccggccagaccgtgaccatcagctgcagcggcagcaccagcaacatcggcaagaacgacgtgagctggtaccagcagctgcccggcaccgcccccaagctgctgatcagcgacaacaacagaagacccagctggacccccgacagattcagcggcagcaagagcggcaccagcgccaccctggccatcaccggcctgcagaccggcgacgaggccgactactactgcgagacctgggacggcagcggcggcgtgttcggccccggcaccagagtgaccgtgctg

SEQ ID NO: 33066 - RNA, 333 nt, synthetic construct
  misc_feature 1..333: note = derived and/or modified sequence opt4 from anti-HIV_119-022334_VR-Chain
  source 1..333: mol_type = other RNA
cagagcgtgctgacccagccccccagcgtgagcgccgcccccggccagaacgtgaacatcagctgcagcggcggcagcagcaacatcggcagcaactacgtgagctggtaccagcagttccccggcaccgcccccaagcacctgatctacgagaacaacaagagacccagcggcatccccgacagattcagcgacagccagagcggcaccagcgccaccctgggcatcaccggcctgcagaccggcgacgaggccgactactactgcggcacctgggacggcagcctgagaaccggcggcgtgatcggcaccggcaccagagtgaccgtgctg

SEQ ID NO: 33067 - RNA, 321 nt, synthetic construct
  misc_feature 1..321: note = derived and/or modified sequence opt4 from anti-HIV_119-021866_VR-Chain
  source 1..321: mol_type = other RNA
cagagcgtgctgacccagccccccagcgtgagcgccgcccccggccagagagtgaccatcagctgcagcggcagcgccagcaacatcggcaagaacttcgtgagctggtaccagcagctgcccggcaaggcccccaagctgatcatctacgaggtgaccaagagacccagcggcgtgcccgccagattcagcggcagcaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 33068 - RNA, 324 nt, synthetic construct
  misc_feature 1..324: note = derived and/or modified sequence opt4 from anti-HIV_119-021278_VR-Chain
  source 1..324: mol_type = other RNA
cagagcgtgctgacccagccccccagcgtgagcgccgcccccggccagaaggtgaccatcagctgcagcggcagcgccagcaacatcggcaagaacttcgtgagctggtaccagcagctgcccggcaccgcccccaagctgctgatctacgagaacaacagaagacccagcggcacccccgacagattcagcggcagcagaagcggcaccagcgccaccctgggcatcaccggcctgcagaccggcgacgaggcccactactactgcgagacctgggacgacagcggcggcgtgttcggcaccggcaccaaggtgaccgtgctg

SEQ ID NO: 33069 - RNA, 333 nt, synthetic construct
  misc_feature 1..333: note = derived and/or modified sequence opt4 from anti-HIV_119-021183_VR-Chain
  source 1..333: mol_type = other RNA
cagagcgtgctgacccagccccccagcgtgagcgccgcccccggccagaaggtgaccatcagctgcagcggcaacagcagcaacatcggcaacaacttcgtgagctggtaccagcagttccccggcaccgcccccaagctgctggtgttcgagacccacagaagacccagcggcatccccgacagattcagcggcagcaagagcggcaccagcgccaccctggccatcaccggcctgcagaccggcgacgaggccgactactactgcgccgtgtggggcgtgagaagaggcgtgggcgccgtgttcggcgccggcaccaaggtgaccgtgctg

SEQ ID NO: 33070 - RNA, 333 nt, synthetic construct
  misc_feature 1..333: note = derived and/or modified sequence opt4 from anti-HIV_119-019376_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcaggtgcccggcaccgcccccaagctgctggtgtacgagacctacagaagacccagcggcatccccgacagattcagcggcagcaagagcggcaccagcgccaccctggccatcaccggcctgcagaccggcgacgaggccgactactactgcaccatctggggcgtgagaaagggcgtgggcgccgtgttcggcaccggcaccaaggtgaccgtgctg

SEQ ID NO: 33071 - RNA, 321 nt, synthetic construct
  misc_feature 1..321: note = derived and/or modified sequence opt4 from anti-HIV_119-019238_VR-Chain
  source 1..321: mol_type = other RNA
cagagcgtgctgacccagccccccagcgtgagcgccgcccccggccagaaggtgaccatcagctgcagcggcaccagcagcaacatcggcaacaaccacgtgagctggtaccagcaggtgcccggcaccgcccccaagctgctgatctacgagaacaacaagagacccagcggcatccccgccagattcagcgccgccaagagcggcaccagcgccaccctggccatcaccggcctgcagaccggcgacgaggccgactacttctgcgccacctggagcggcagactgaacatcggcaccggcaccaaggtgaccgtgctg

SEQ ID NO: 33072 - RNA, 333 nt, synthetic construct
  misc_feature 1..333: note = derived and/or modified sequence opt4 from anti-HIV_119-018500_VR-Chain
  source 1..333: mol_type = other RNA
cagagcgtgctgacccagccccccagcgtgagcgccgcccccggccagaaggtgaacatcagctgcagcggcagcagcagcaacatcggcaacaacttcgtgagctggtaccagcagagacccggcaccgcccccaagctgctgatctacgagaccaacagaagacccagcggcatccccgacagattcagcggcagcaagagcggcaccagcgccaccctggccatcaccggcctgcagaccggcgacgaggccgactactactgcgccacctgggccgccagcctgaccagcgccagagtgttcggcatcggcaccaaggtgaccgtgctg

SEQ ID NO: 33073 - RNA, 324 nt, synthetic construct
  misc_feature 1..324: note = derived and/or modified sequence opt4 from anti-HIV_119-018318_VR-Chain
  source 1..324: mol_type = other RNA
cagagcgtgctgacccagccccccagcgtgagcgccgcccccggccagaccgtgatcatcagctgcagcggcagcaccagcaacatcggcaagaacgacgtgagctggtaccagcagctgcccggcaccgcccccaagctgctgatcagcgagaacaacagaagacccagcggcacccccgacagattcagcggcagcaagagcggcaccagcgccaccctggccatcaccggcctgcagaccggcgacgacgccgactactactgcgagacctgggacggcagcggcggcgtgttcggcaccggcaccaaggtgaccctggtg

SEQ ID NO: 33074 - RNA, 333 nt, synthetic construct
  misc_feature 1..333: note = derived and/or modified sequence opt4 from anti-HIV_119-018218_VR-Chain
  source 1..333: mol_type = other RNA
cagagcgtgctgacccagccccccagcgtgagcgccgcccccggccagaaggtgaccatcagctgcagcggcaacagcagcaacatcggcaacaacttcgtgagctggtaccagcagctgcccggcaccgcccccaagctgctgatctacgagaacaacagaagacccagcggcatccccgacagattcagcggcagcaagagcggcaccagcgccaccctggccatcagcggcctgcagaccggcgacgaggccgactactggtgcgccgtgtggggcgtgagaagaggcgccggcgccgtgttcggcgccggcaccaaggtgaccgtgctg

SEQ ID NO: 33075 - RNA, 324 nt, synthetic construct
  misc_feature 1..324: note = derived and/or modified sequence opt4 from anti-HIV_119-017876_VR-Chain
  source 1..324: mol_type = other RNA
cagagcgtgctgacccagccccccagcgtgagcgccgcccccggccagaaggtgaccatcagctgcagcggcagcaccagcaagatcggccagaacagcgtgagctggtaccagcagctgcccggcaccgcccccaagctgctgatctacgagaacgacagaagacccagcggcacccccgacagattcagcgccagcaagagcggcaccagcgccaccctggccatcaccggcctgcagaccggcgacgaggccgactactactgcgagacctgggacgacagcggcggcgtgttcggcaccggcaccaaggtgaccgtgctg

SEQ ID NO: 33076 - RNA, 324 nt, synthetic construct
  misc_feature 1..324: note = derived and/or modified sequence opt4 from anti-HIV_119-017740_VR-Chain
  source 1..324: mol_type = other RNA
cagagcgtgctgacccagccccccagcgtgagcgccgcccccggccagaaggtgaccatcagctgcagcggcagcaacagcaacatcggcaacaaggacgtgagctggtacagacaggtgcccgccaccgcccccaagctgcccatctacgagaacaagaacgagcccagcggcgtgcccgacagattcagcggcagcaagagcggcaccagcgccaccctggccatcaccggcctgcagaccggcgacgaggccgactactactgcgccacctgggacggcagagtgagcgtgatcggcaccggcaccaaggtgaccgtggtg

SEQ ID NO: 33077 - RNA, 321 nt, synthetic construct
  misc_feature 1..321: note = derived and/or modified sequence opt4 from anti-HIV_119-017128_VR-Chain
  source 1..321: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcgccaagagcggcaccagcgccaccctggccatcaccggcctgcagaccggcgacgaggccgactacttctgcagcacctggagcggcagcctgaacttcggcaccggcaccagagtgaccgtgctg

SEQ ID NO: 33078 - RNA, 324 nt, synthetic construct
  misc_feature 1..324: note = derived and/or modified sequence opt4 from anti-HIV_119-017044_VR-Chain
  source 1..324: mol_type = other RNA
cagagcgtgctgacccagccccccagcgtgagcgccgcccccggccagaaggtgaccatcagctgcagcggcagcaacagcaacatcggcaacaactacgtgagctggtaccaccacctgcccggcaccgcccccagactgctgatctacgacaacaacaagagacccagcggcatccccgacagattcagcggcagcaagagcggcaccagcgccaccctggccatcaccggcctgcagaccggcgacgaggccgactactactgcgccacctgggacggcagagtgagcgtgatcggcaccggcacccaggtgaccgtgctg

SEQ ID NO: 33079 - RNA, 321 nt, synthetic construct
  misc_feature 1..321: note = derived and/or modified sequence opt4 from anti-HIV_119-016644_VR-Chain
  source 1..321: mol_type = other RNA
cagagcgtgctgacccagccccccagcgtgagcgccgcccccggccagaaggtgaccatcagctgcagcggcggcaccagcaacatcggcaacaactacgtgagctggtaccagcagctgcccggcaccgcccccaagctgctgatctacgagaacaacaagagacccagcggcatccccgccagattcagcgccgccaagagcggcaccagcgccaccctggccatcaccggcctgcagaccgaggacgaggccgactactactgcgccacctggagcggcagcctgaacatcggcaccggcaccaaggtgaccgtgctg

SEQ ID NO: 33080 - RNA, 333 nt, synthetic construct
  misc_feature 1..333: note = derived and/or modified sequence opt4 from anti-HIV_119-015878_VR-Chain
  source 1..333: mol_type = other RNA
cagagcgccctgacccagccccccagcgccagcggcagccccggccagagcgtgaccatcagctgcagcggcagcagcagcaacatcggcaacaacttcgtgagctggtaccagcagagacccggcaccgcccccaagctgctgatctacgagaccaacaagagacccagcggcatccccgacagattcagcggcagcaagagcggcaccagcgccaccctggccatcaccggcctgcagaccggcgacgaggccgactactactgcgccacctgggcccccagactgaacagcgccagagtgttcggcaacggcaccatggtgaccgtgctg

SEQ ID NO: 33081 - RNA, 321 nt, synthetic construct
  misc_feature 1..321: note = derived and/or modified sequence opt4 from anti-HIV_119-015538_VR-Chain
  source 1..321: mol_type = other RNA
cagagcgtgctgacccagccccccagcgtgagcgccacccccggccagaaggtgaccatcagctgcagcggcagcagcagcaacatcggcaacaactacgtgagctggtacagaagactgcccggcaccgcccccaagcacctgatctacgagaccaacaacagacccagcggcgtgcccgccagactgagcgccgccaagagcggcaccagcgccaccctggccatcaccggcctgcagaccgaggacgaggccgactactactgcgccacctggagcggcagcctgaacatcggcaccggcaccaaggtgaccgtgctg

SEQ ID NO: 33082 - RNA, 321 nt, synthetic construct
  misc_feature 1..321: note = derived and/or modified sequence opt4 from anti-HIV_119-015455_VR-Chain
  source 1..321: mol_type = other RNA
cagagcgtgctgacccagccccccagcgtgagcgccacccccggccagaaggtgaccatcagctgcagcggcagcaacagcaacatcggcaacaaggacgtgagctggtaccagcacttccccggcaccgcccccaagctgctgatctacgagaacaacaagagacccagcggcatccccgacagattcagcggcagcaagagcgccaccagcgccaccctgaccatcaccggcctgcagaccgaggacgaggccgactactactgcgccacctggagcggcagcctgaacatcggcaccggcaccaaggtgaccgtgctg

SEQ ID NO: 33083 - RNA, 321 nt, synthetic construct
  misc_feature 1..321: note = derived and/or modified sequence opt4 from anti-HIV_119-014425_VR-Chain
  source 1..321: mol_type = other RNA
cagagcgtgctgacccagccccccagcgtgagcgccgcccccggccagaaggtgaccatcagctgcagcggcggcaccagcaacatcggcaacaactacgtgagctggtaccagcacctgcccggcaccgcccccaagctgctgatctacgagaacaacaagagacccagcggcatccccgacagattcagcggcgccaagagcggcaccagcgccaccctggccatcaccggcctgcagaccggcgacgagggcgactactactgcgccacctggagcggcagcctgaacatcggcaccggcaccaaggtgaccgtgctg

SEQ ID NO: 33084 - RNA, 324 nt, synthetic construct
  misc_feature 1..324: note = derived and/or modified sequence opt4 from anti-HIV_119-013582_VR-Chain
  source 1..324: mol_type = other RNA
cagagcatggtgacccagagccccagcgtgagcgccgcccccggccagaaggtgaccatcagctgcagcggcaccagcagcaacatcggccagaactacgtgagctggtaccagcagctgcccggcaccgcccccaagctgctgatcagcgagaacaacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33085 - RNA, 333 nt, synthetic construct
  misc_feature 1..333: note = derived and/or modified sequence opt4 from anti-HIV_119-013364_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaacaacaagagacccagcggcatccccgacagattcagcggcagcaagagcggcaccagcgccaccctggccatcaccggcctgcacaccggcgacgaggccgactactactgcaccgtgtggggcgtgagaaagggcgtgggcgccgtgttcggcaccggcaccaaggtgaccgtgctg

SEQ ID NO: 33086 - RNA, 333 nt, synthetic construct
  misc_feature 1..333: note = derived and/or modified sequence opt4 from anti-HIV_119-012886_VR-Chain
  source 1..333: mol_type = other RNA
cagagcatcctgacccagccccccagcgtgagcgccgcccccggccagaaggtgaccatcagctgcagcggcagcagcagcaccatcggcaccaactacgtgagctggtaccagcagttccccggcaccgcccccaagctgctggtgttcgagacccacagaagacccagcggcatccccgacagattcagcggcagcaagagcggcaccagcgccaccctggccatcaccggcctgcagaccggcgacgaggccgactactactgcgccgtgtggggcgtgagaagaggcgtgggcgccgtgttcggcgccggcaccaaggtgaccgtgctg

SEQ ID NO: 33087 - RNA, 333 nt, synthetic construct
  misc_feature 1..333: note = derived and/or modified sequence opt4 from anti-HIV_119-012249_VR-Chain
  source 1..333: mol_type = other RNA
cagagcgtgctgacccagccccccagcgtgagcggcgcccccggccagaaggtgaccatcagctgcagcggcagcagcagcaacatcggcagaaactacgtgagctggtaccagcagctgcccggcaccgcccccaagctgctgatctacgagaacaacaagagacccagcggcatccccgacagattcagcggcagcaagagcggcaccagcgccaccctggtgatcaccggcctgcagaccggcgacgaggccgacttctactgcggcacctgggacggcagcctgagcggcggcggcgtgatcggcaccggcaccagagtgaccgtgctg

SEQ ID NO: 33088 - RNA, 324 nt, synthetic construct
  misc_feature 1..324: note = derived and/or modified sequence opt4 from anti-HIV_119-012161_VR-Chain
  source 1..324: mol_type = other RNA
cagagcttcctgacccagccccccagcgtgagcgccgcccccggccagaaggtgaccatcagctgcagcggcagcaacagcaacatcggcaagaactacgtgagctggtaccagtacctgcccggcaccgtgcccaagctgctgatctacgagaacgacaagagacccagcggcatccccggcagattcagcgccagcaagagcggcaccagcgccaccctggccatcaccggcctgcagaccggcgacgaggccgactactactgcggcacctgggacggcagcggcggcgtgttcggcaccggcaccaaggtgaccgtgctg

SEQ ID NO: 33089 - RNA, 324 nt, synthetic construct
  misc_feature 1..324: note = derived and/or modified sequence opt4 from anti-HIV_119-012110_VR-Chain
  source 1..324: mol_type = other RNA
cagagcgtgctgacccagccccccagcgtgagcgccgcccccggccagaccgtgaccatcagctgcagcggcagcaccagcaacatcggcaagaacgacgtgagctggtaccagcagctgcccggcaccgcccccaagctgctgatcagcgagaacaacagaagacccagcggcacccccgacagattcagcggcagcaagagcggcaccagcgccaccctggccatcagcggcctgcagaccggcgacgaggccgactactactgcggcacctgggacggcagcggcggcgtgttcggcaccggcaccaaggtgaccgtgctg

SEQ ID NO: 33090 - RNA, 333 nt, synthetic construct
  misc_feature 1..333: note = derived and/or modified sequence opt4 from anti-HIV_119-012100_VR-Chain
  source 1..333: mol_type = other RNA
caggccgtgctgacccagccccccagcgtgagcgccgcccccggccagaaggtggccatcagctgcagcggcagcagcagcaacatcggcaacaactacgtgagctggtaccagcagctgcccggcaccgtgcccaagctgctgatctacgacaccgacaagagacccagcggcatccccgacagattcagcggcagcaagagcggcaccagcgccaccctgggcatcaccagactgcagaccggcgacgaggccgactactactgcgccacctgggcccccagactgaacagcgccagagtgttcggcaacggcaccatggtgaccgtgctg

SEQ ID NO: 33091 - RNA, 324 nt, synthetic construct
  misc_feature 1..324: note = derived and/or modified sequence opt4 from anti-HIV_119-011651_VR-Chain
  source 1..324: mol_type = other RNA
cagagcgtgctgacccagccccccagcgtgagcgccgcccccggccagaaggtgaccatcagctgcagcggcaacagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcgccacctgggacggcagagtgagcgtgttcggcaccggcaccaaggtggccgtgctg

SEQ ID NO: 33092 - RNA, 333 nt, synthetic construct
  misc_feature 1..333: note = derived and/or modified sequence opt4 from anti-HIV_119-011479_VR-Chain
  source 1..333: mol_type = other RNA
cagagcgtgctgacccagccccccagcgtgagcgccacccccggccagaaggtgaccatcagctgcagcggcagcaacagcaacatcggcaacaagtacgtgagctggtaccagcacttccccggcaccgcccccaagctgctgatctacgagaacaacagaagacccagcggcatccccgacagattcagcggcagcaagagcggcaccagcgccaccctggccatcaccggcctgcagaccggcgacgaggccgactactactgcaccatctggggcgtgagaaagggcgtgggcgccgtgttcggcaccggcaccaaggtgaccgtgctg

SEQ ID NO: 33093 - RNA, 333 nt, synthetic construct
  misc_feature 1..333: note = derived and/or modified sequence opt4 from anti-HIV_119-011232_VR-Chain
  source 1..333: mol_type = other RNA
cagagcgtgctgacccagccccccagcgtgagcgccgcccccggccagaacgtgaacatcagctgcagcggcggcagcagcaacatcggcagcaactacgtgagctggtaccagcagttccccggcaccgcccccaagctgctgatctacgacgacgacaagagacccagcggcatcccccacagattcagcgccagcaagagcggcaccagcgccaccctggccatcagcggcctgcagaccggcgacgaggccgactactgctgcgccgtgtggggcgtgagaagaggcgccggcgccgtgttcggcgccggcaccaaggtgaccgtgctg

SEQ ID NO: 33094 - RNA, 333 nt, synthetic construct
  misc_feature 1..333: note = derived and/or modified sequence opt4 from anti-HIV_119-011175_VR-Chain
  source 1..333: mol_type = other RNA
cagagcgtgctgacccagccccccagcgtgagcgccgcccccggccagaaggtgaccatcagctgcagcggcagcaacagctacatcggcaacaagtacgtgagctggtaccagcagttccccggcaccgcccccaagctgctgatctacgagaacaacagaagacccagcggcatccccgacagattcagcggcagcaagagcggcaccagcgccaccctggccatcagcggcctgcagaccggcgacgaggccgactactgctgcgccgtgtggggcgtgagaagaggcgccggcgccgtgttcggccccggcaccaaggtgaccgtgctg

SEQ ID NO: 33095 - RNA, 321 nt, synthetic construct
  misc_feature 1..321: note = derived and/or modified sequence opt4 from anti-HIV_119-008396_VR-Chain
  source 1..321: mol_type = other RNA
cagagcgtgctgacccagccccccagcgtgagcgccgcccccggccagaaggtgaccatcagctgcagcggcagcagcagcaacatcggcaacaactacgtgagctggtaccagcaggtgcccggcaccgcccccaagctgctggtgtacgagaacaccagaagacccagcggcgtgcccgacagattcagcggcgccaagagcggcaccagcgccaccctggccatcaccggcctgcagaccggcgacgagggcgactactactgcgccacctggagcggcagcctgaacatcggcaccggcaccaaggtgaccgtgctg

SEQ ID NO: 33096 - RNA, 324 nt, synthetic construct
  misc_feature 1..324: note = derived and/or modified sequence opt4 from anti-HIV_119-007148_VR-Chain
  source 1..324: mol_type = other RNA
cagagcgtgctgacccagccccccagcgtgagcgccgcccccggccagaaggtgaccatcagctgcagcggcagcaccagcaacatcggcaagaactacgtgagctggtaccagcacctgcccggcaccgcccccaagctgctgctgtacgagaacgacagaagacccagcggcacccccgacagattcagcggcagcaagagcggcaccagcgccaccctggccatcaccggcctgcacaccggcgacgaggccgactactactgcgagacctgggacggcagcggcggcgtgttcggcaccggcaccaaggtgaccgtgctg

SEQ ID NO: 33097 - RNA, 333 nt, synthetic construct
  misc_feature 1..333: note = derived and/or modified sequence opt4 from anti-HIV_119-007029_VR-Chain
  source 1..333: mol_type = other RNA
cagagcgtgctgacccagccccccagcgtgagcgccgcccccggccagaaggtgaccatcagctgcagcggcaacagcagcaacatcggcaacaacttcgtgagctggtaccagcaggtgcccggcaccgcccccaagctgctgctgtacgagacctacagaagacccagcggcatcagcgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 33098 - RNA, 324 nt, synthetic construct
  misc_feature 1..324: note = derived and/or modified sequence opt4 from anti-HIV_119-004707_VR-Chain
  source 1..324: mol_type = other RNA
cagagcgtgctgacccagccccccagcgtgagcgccgcccccggccagaaggtgaccatcagctgcagcggcagcaccagcaacatcggcaagaacgacgtgagctggtaccagcagctgcccggcaccgcccccaagctgctgatcagcgagaacaacagaagacccagcggcacccccgacagattcagcggcagcaagagcggcaccagcgccaccctggccatcaccggcctgcagaccggcgacgaggccgactactactgcgagacctgggacggcagcggcggcgtgttcggcaccggcaccaaggtgaccgtgctg

SEQ ID NO: 33099 - RNA, 333 nt, synthetic construct
  misc_feature 1..333: note = derived and/or modified sequence opt4 from anti-HIV_119-003910_VR-Chain
  source 1..333: mol_type = other RNA
cagagcgtgctgacccagccccccagcgtgagcgccgcccccggccagaaggtggccatcagctgcagcggcaacaccagcagcatcggcaacaacttcgtgagctggtaccagcaggtgcccggcaccgcccccaagctgctggtgtacgagacctacagaagacccagcggcatccccgacagattcagcggcagcaagagcggcaccagcgccaccctggccatcaccggcctgcagaccggcgacgaggccgactactactgcaccgtgtggggcgtgagaaagggcgtgggcgccgtgttcggcaccggcaccaaggtgaccgtgctg

SEQ ID NO: 33100 - RNA, 321 nt, synthetic construct
  misc_feature 1..321: note = derived and/or modified sequence opt4 from anti-HIV_119-002450_VR-Chain
  source 1..321: mol_type = other RNA
cagagcgtgctgacccagccccccagcgtgagcggcgcccccggccagagagtgaccatcagctgcaccggcagcagcagcaacatcggcaacaactacgtgagctggtaccagggcctgcccggcaccgcccccaagctgctgatctacgagaacaacaagagacccagcggcatccccgacagattcagcggcgccaagagcggcaccgccgccaccctggccatcaccggcctgcagaccggcgacgaggccgactactactgcgccacctggagcggcagcctgaacttcggcaccggcaccaaggtgaccgtgctg

SEQ ID NO: 33101 - RNA, 321 nt, synthetic construct
  misc_feature 1..321: note = derived and/or modified sequence opt4 from anti-HIV_119-001552_VR-Chain
  source 1..321: mol_type = other RNA
cagagcgtgctgacccagccccccagcgtgagcgccgcccccggccagaaggtgaccatcagctgcagcggcagcaacagctacctgggcaacaagtacgtgagctggtaccagcagttccccggcaccgcccccaagctgctgatctacgagaacaacaagagacccagcggcatccccgacagattcagcgccagcaagagcgccgccagcgccaccctggccatcaccggcctgcagaccggcgacgagggcgactactactgcgccacctggaccggcagcctgaacatcggcaccggcaccaaggtgaccgtgctg

SEQ ID NO: 33102 - RNA, 333 nt, synthetic construct
  misc_feature 1..333: note = derived and/or modified sequence opt4 from anti-HIV_059-188169_VR-Chain
  source 1..333: mol_type = other RNA
cagagcgtgctgacccagccccccagcgtgagcgccgcccccggccagaaggtgaccatcagctgcagcggcagcaccagcaacatcggcgacaactacgtgagctggtaccagcaggtgcccggcaccgcccccaagctgctgatctacgagaacaacagaagacccagcggcacccccgacagattcagcggcagcaagagcggcaccagcgccaccctggccatcaccggcctgcagaccggcgacgaggccgactactactgcggcacctgggacaccagcctgagcaccggcggcgtgttcggcaccggcaccaaggtgaccgtgctg

SEQ ID NO: 33103 - RNA, 333 nt, synthetic construct
  misc_feature 1..333: note = derived and/or modified sequence opt4 from anti-HIV_059-183739_VR-Chain
  source 1..333: mol_type = other RNA
cagagcgtgctgacccagccccccagcgtgagcgccgcccccggccagaaggtgaccatcagctgcagcggcagcaccagcaacatcggcaagaactacgtgagctggtaccagcagctgcccggcaccgcccccaagctgctgatctacgagaacaacagaagacccagcggcacccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33104 - RNA, 333 nt, synthetic construct
  misc_feature 1..333: note = derived and/or modified sequence opt4 from anti-HIV_059-182376_VR-Chain
  source 1..333: mol_type = other RNA
cagagcgtgctgagccagccccccagcgtgagcgccgcccccggccagaaggtgaccatcagctgcagcggcagcagcagcaacatcggcaactactacgtgagctggtaccagcagttccccggcaccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctggggcaccagcctgagcggcggcggcgtgttcggcaccggcaccaaggtgaccgtgctg

SEQ ID NO: 33105 - RNA, 333 nt, synthetic construct
  misc_feature 1..333: note = derived and/or modified sequence opt4 from anti-HIV_059-182199_VR-Chain
  source 1..333: mol_type = other RNA
cagagcgtgctgacccagccccccagcgtgagcgccgcccccggccagaacatcaccatcagctgcagcggcagcagcagcaacatcggcagccacagcatcagctggtaccagcacctgcccggcaccgcccccaagatcgtgatctacgacaacgacaagagacccctgggcatccccgacagattcagcggcagcaagagcggcaccagcgccaccctgggcatcaccggcctgcagaccggcgacgaggccgactactactgcggcacctgggacaccagcctgagcggcggcggcgtgttcggccccggcaccaaggtgaccgtgctg

SEQ ID NO: 33106 - RNA, 324 nt, synthetic construct
  misc_feature 1..324: note = derived and/or modified sequence opt4 from anti-HIV_059-169202_VR-Chain
  source 1..324: mol_type = other RNA
cacagcgtgctgacccagccccccagcgtgagcgccgcccccggccagaaggtgaccatcagctgcagcggcagcagcagcaagatcggcaacaacttcgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcggcacctgggacggcagagtgagcgtgatcggcagcggcaccaagctgaccgtgctg

SEQ ID NO: 33107 - RNA, 324 nt, synthetic construct
  misc_feature 1..324: note = derived and/or modified sequence opt4 from anti-HIV_059-155645_VR-Chain
  source 1..324: mol_type = other RNA
cagagcgccctgacccagcccgccagcgtgagcggcagccccggccagagcatcaccatcagctgcaccggcaccagcagcgacgtgggctacaactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcggcacctgggacggcagactgagcgtgatcggcaccggcaccaaggtgaccgtgctg

SEQ ID NO: 33108 - RNA, 333 nt, synthetic construct
  misc_feature 1..333: note = derived and/or modified sequence opt4 from anti-HIV_059-151619_VR-Chain
  source 1..333: mol_type = other RNA
cagagcgtgctgacccagccccccagcgtgagcgccgcccccggccagaaggtgaccatcagctgcagcggcagcagcagcaacatcggcaacaacttcgtgagctggtaccagctgctgcccggcaccccccccaagctgctgatcttcaagaacaacgagagacccagcggcatccccgacagattcagcggcagcaagagcggcaccagcgccaccctgggcatcaccggcctgcagaccggcgacgagggcgactactactgcggcacctgggacaccagcctgagcggcggcggcgtgttcggcaccggcaccagagtgaccgtgctg

SEQ ID NO: 33109 - RNA, 333 nt, synthetic construct
  misc_feature 1..333: note = derived and/or modified sequence opt4 from anti-HIV_059-146503_VR-Chain
  source 1..333: mol_type = other RNA
cagagcgtgctgacccagccccccagcgtgagcgccacccccggccagaaggtgaccatcagctgcagcggcagcgccagcaacatcggcaacaactacgtgagctggtaccagcagttccccggcaccgcccccaagctgctgatctacgacaccaacaagagacccagcggcatccccgacagattcagcggcagcaagagcggcaccagcgccatcctgggcatcaccggcctgcagatcggcgacgaggccgactactactgcggcacctgggacaccagcctgagcggcggcggcgtgttcggcaccggcaccaaggtgaccgtgctg

SEQ ID NO: 33110 - RNA, 324 nt, synthetic construct
  misc_feature 1..324: note = derived and/or modified sequence opt4 from anti-HIV_059-136098_VR-Chain
  source 1..324: mol_type = other RNA
cagagcgtgctgacccagccccccagcgtgagcgccgcccccggccagagagtgaccatcagctgcagcggcagcagcagcaacatcggcaacaactacgtgagctggtaccagcagctgcccggcaccgcccccaagctgctgatctacgagaacaacagaagacccagcggcatccccgacagattcagcggcagcaagagcggcaccagcgccaccctggccatcaccggcctgcagaccggcgacgagggcgactactactgcgccagatgggacggcagactgagcgtgatcggcagcggcaccaaggtgaccgtgctg

SEQ ID NO: 33111 - RNA, 333 nt, synthetic construct
  misc_feature 1..333: note = derived and/or modified sequence opt4 from anti-HIV_059-105516_VR-Chain
  source 1..333: mol_type = other RNA
cagagcgccctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaacaacaagagacccagcggcatccccgacagattcagcggcagcaagagcggcaccagcgccaccctggccatcgccggcctgcagaccggcgacgaggccaactactactgcggcacctgggacggcagcctgagaaccggcggcgtgttcggcaccggcaccaaggtgaccgtgctg

SEQ ID NO: 33112 - RNA, 333 nt, synthetic construct
  misc_feature 1..333: note = derived and/or modified sequence opt4 from anti-HIV_059-095709_VR-Chain
  source 1..333: mol_type = other RNA
cagagcgtgctgacccagccccccagcgtgagcgccgcccccggccagaaggtgaccatcagctgcagcggcagaagcagcaacatcggcaacaacttcgtgagctggtaccagctgctgcccggcaccgcccccaagctgctgatctacaagaacaacgagagacccagcggcatccccgacagattcagcgccagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33113 - RNA, 333 nt, synthetic construct
  misc_feature 1..333: note = derived and/or modified sequence opt4 from anti-HIV_059-069468_VR-Chain
  source 1..333: mol_type = other RNA
cagagcgtgctgacccagccccccagcgtgagcggcgcccccagacagagcgtgatcatcagctgcaccggcagcagcagcaacatcggcggcttcgacgtgcactggtaccagcagctgcccggcaccgcccccaagctgctgatctacgagaacaacagaagacccagcggcacccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33114 - RNA, 333 nt, synthetic construct
  misc_feature 1..333: note = derived and/or modified sequence opt4 from anti-HIV_059-060026_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgtgcccaagctgctgatctacaagaacgacaagagacccagcggcatccccgacagattcagcggcagcaagagcgccaccagcgccaccctgggcatcaccggcctgcagaccggcgacgaggccgactactactgcggcatctgggacaccagcctgagcgccggcggcgtgttcggcaccggcaccagagtgaccgtgctg

SEQ ID NO: 33115 - RNA, 333 nt, synthetic construct
  misc_feature 1..333: note = derived and/or modified sequence opt4 from anti-HIV_059-053668_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagaagcagcggcatccccgacagattcagcggcagcaagagcggcaccagcgccaccctggccatcaccggcctgcagaccggcgacgaggccgactactactgcggcaccagagacagcagcctgagcggcggcggcgtgatcggcaccggcaccaaggtgaccgtgctg

SEQ ID NO: 33116 - RNA, 333 nt, synthetic construct
  misc_feature 1..333: note = derived and/or modified sequence opt4 from anti-HIV_059-052864_VR-Chain
  source 1..333: mol_type = other RNA
cagagcgtgctgacccagccccccagcctgagcgccgcccccggccagagagtgaccatcagctgcagcggcagcagcagcaacatcggcaacaactacgtgagctggtaccagcagctgcccggcaccgcccccaagctgctgatctacgagagcaacaagagacccagcggcacccccgacagattcagcggcagcaagagcggcaccagcgccaccctggccatcaccggcctgcagaccggcgacgaggccgactactactgcggcacctgggacgccagcctgagcagcggcggcgtgatgggcaccggcaccaaggtgaccgtgctg

SEQ ID NO: 33117 - RNA, 333 nt, synthetic construct
  misc_feature 1..333: note = derived and/or modified sequence opt4 from anti-HIV_059-050968_VR-Chain
  source 1..333: mol_type = other RNA
cagagcgtgctgacccaggcccccagcgtgagcgccgcccccggcgagaaggtgaccatcagctgcagcggcaccagcagcaacatcggctactactacgtgagctggtaccagcagttccccggcaccgcccccaaggtggtgatctacgagaacaacagaagacccagcggcacccccgacagattcagcggcagcaagagcggcaccagcgccaccctggccatcaccggcctgcagaccggcgacgaggccgactactactgcggcacctggggcggcagcctgagcaccggcggcgtgatcggcaccggcaccaaggtgaccgtgctg

SEQ ID NO: 33118 - RNA, 333 nt, synthetic construct
  misc_feature 1..333: note = derived and/or modified sequence opt4 from anti-HIV_059-046422_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacatcagctggtaccagctgctgcccggcaccccccccaactacctgatcttcaagatcagcgagagacccagcggcgtgcccgacagattcagcggcagcaagagcggcaccagcgccaccctgcacatcaccggcctgcagaccggcgacgagggcgactactactgcggcacctgggacaccagcctgagcggcggcggcgtgttcggcaccggcaccaaggtgaccgtgctg

SEQ ID NO: 33119 - RNA, 333 nt, synthetic construct
  misc_feature 1..333: note = derived and/or modified sequence opt4 from anti-HIV_059-045120_VR-Chain
  source 1..333: mol_type = other RNA
cagagcgtgctgacccagccccccagcgtgagcgccgcccccggccagaaggtggccatcagctgcagcggcagcagcagcaccatcggcaacaactacgtgagctggtaccagctgctgcccggcaccccccccaagctgctgatcttcaagagccacgagagacccagcggcatccccgacagattcagcggcagcaagagcggcaccagcgccaccctgggcatcaccggcctgcagaccggcgacgagggcgactactactgcggcacctgggacagcagcctgagcgtgggcggcgtgttcggcaccggcaccaaggtgaccgtgctg

SEQ ID NO: 33120 - RNA, 333 nt, synthetic construct
  misc_feature 1..333: note = derived and/or modified sequence opt4 from anti-HIV_059-039932_VR-Chain
  source 1..333: mol_type = other RNA
cagagcgtgctgacccagccccccagcgtgagcgccgcccccggccagaaggtgaccatcagctgcagcggcagcagcagcatcatcggcaagaactacgtgagctggtaccagcacctgcccggcaccgcccccaagctgctgatctacgagaacaacaagagacccagcggcatccccgacagattcagcggcagcaagagcggcaccagcgccaccctggccatcgccggcctgcagaccggcgacgaggccaactactactgcggcacctggggcggcagcctgagcaccggcggcgtgttcggcaccggcaccaaggtgaccgtgctg

SEQ ID NO: 33121 - RNA, 333 nt, synthetic construct
  misc_feature 1..333: note = derived and/or modified sequence opt4 from anti-HIV_059-038595_VR-Chain
  source 1..333: mol_type = other RNA
cagagcgtgctgacccagccccccagcgtgagcgccgcccccggccagaaggtgaccatcagctgcagcggcagaagcagcaacatcggcaacaacttcgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgatcgtgctg

SEQ ID NO: 33122 - RNA, 333 nt, synthetic construct
  misc_feature 1..333: note = derived and/or modified sequence opt4 from anti-HIV_059-035082_VR-Chain
  source 1..333: mol_type = other RNA
cagagcgtgctgacccagccccccagcgtgagcgccgcccccggccagaaggtgaccatcagctgcagcggcagcaccagcaacatcggcaagagcttcgtgagctggtaccagcagctgcccggcaccgcccccaagctgctgatctacgacaacaacagaagacccagcggcacccccgacagattcagcggcagcaagagcggcaccagcgccaccctggccatcaccggcctgcagaccggcgacgaggccgactactactgcggcacctggggcggcagcctgagcaccggcggcgtgatcggcaccggcaccaaggtgaccgtgctg

SEQ ID NO: 33123 - RNA, 333 nt, synthetic construct
  misc_feature 1..333: note = derived and/or modified sequence opt4 from anti-HIV_059-029204_VR-Chain
  source 1..333: mol_type = other RNA
cagagcgtgctgacccagccccccagcgtgagcgccgcccccggccagaaggtgaccatcagctgcagcggcagcaccagcaacatcggcaagatcctggtgagctggtaccagcagctgcccggcaccgcccccaagcccagcatctacgacaacaacagaagacccagcggcacccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgccc

SEQ ID NO: 33124 - RNA, 324 nt, synthetic construct
  misc_feature 1..324: note = derived and/or modified sequence opt4 from anti-HIV_059-025235_VR-Chain
  source 1..324: mol_type = other RNA
cagagcgtgctgacccagccccccagcgtgagcggcgcccccggccagaagatcaccatcagctgcagcggcagcaccagcaacatcggcaagagctacgtgagctggtaccagcagctgcccggcaccgcccccaagctgctgatctacgagaacaacagaagacccagcggcacccccgacagattcagcggcagcaagagcggcaccagcgccaccctggccatcaccggcctgcagaccggcgacgaggccgactactactgcggcacctgggacggcagcggcggcgtgatcggcaccggcaccaaggtgaccgtgctg

SEQ ID NO: 33125 - RNA, 333 nt, synthetic construct
  misc_feature 1..333: note = derived and/or modified sequence opt4 from anti-HIV_059-015192_VR-Chain
  source 1..333: mol_type = other RNA
cagagcgtgctgacccagccccccagcgtgagcgccgcccccggccagaaggtgaccatcagctgcagcggcagcagcagcaccatcggcgacaagtacgtgagctggtaccagctgctgcccggcaccgcccccaagctgctgatctacaagaacaacaagagacccagcggcatccccgacagattcagcggcagcaagagcggcaccagcgccaccctgggcatcaccggcctgcagaccggcgacgaggccgactactactgcggcacctgggacaccagcctgagcgtgggcggcgtgttcggcaccggcaccaaggtgaccgtgctg

SEQ ID NO: 33126 - RNA, 333 nt, synthetic construct
  misc_feature 1..333: note = derived and/or modified sequence opt4 from anti-HIV_059-007060_VR-Chain
  source 1..333: mol_type = other RNA
cagagcgtgctgacccagccccccagcgtgagcgccgcccccggccagaaggtgaccatcagctgcagcggcagcagcagcaacatcggcaacaagtacgtgagctggtaccagcagctgcccggcaccgcccccaagctgctgatctacgagaacaagaagagacccagcggcatccccgacagattcagcggcagcaagagcggcaccagcgccaccctgggcatcaccggcctgcagaccggcgacgaggccgactacttctgcggcacctgggacaccagcctgagcggcggcggcgtgttcggcagcggcaccaaggtgaccgtgctg

SEQ ID NO: 33127 - RNA, 324 nt, synthetic construct
  misc_feature 1..324: note = derived and/or modified sequence opt4 from anti-HIV_059-006953_VR-Chain
  source 1..324: mol_type = other RNA
cagagcgtgctgacccagccccccagcgtgagcgccgcccccggccagaaggtgaccatcagctgcagcggcagcagcagcaacatcggcgtgagctggtaccagcaggtgcccggcaccgcccccaagctgctgatctacgacaacgacaagagacccaccggcatccccgacagattcagcggcagcaagagcggcaccagcgccatcctggccatcaccggcctgcagaccggcgacgagggcgactactactgcggcacctgggagaccagcctgagcggcggcggcgtgttcggcaccggcaccaaggtgaccgtgctg

SEQ ID NO: 33128 - RNA, 333 nt, synthetic construct
  misc_feature 1..333: note = derived and/or modified sequence opt4 from anti-HIV_059-005953_VR-Chain
  source 1..333: mol_type = other RNA
cacagcgtgctgacccagccccccagcgtgagcgccgcccccggccagaaggtgaccatcagctgcagcggcaccagcagcaacatcggcaagaactacgtgagctggtaccagcagctgcccggcaccgcccccaagctgctgatctacgagaacaacagaagacccagcggcacccccgacagattcagcggcagcaagagcggcaccagcgccaccctggccatcaccggcctgcagaccggcgacgaggccgactactactgcggcacctgggacaccagcctgagcaccggcggcgtgttcggcaccggcaccaaggtgaccgtgctg

SEQ ID NO: 33129 - RNA, 324 nt, synthetic construct
  misc_feature 1..324: note = derived and/or modified sequence opt4 from anti-HIV_059-003725_VR-Chain
  source 1..324: mol_type = other RNA
cagagcgtgctgacccagccccccagcgtgagcgccgcccccggccagaagctgaccatcagctgcagcggcagcaccagcaagatcggcaacaactacgtgagctggtaccagcacctgcccggcaccgcccccaagctgctggtgtacgagaacaacaagagacccagcggcatccccgacagattcagcggcagcaagagcggcaccagcgccaccctggccatcaccggcctgcagaccggcgacgaggccgactactactgcggcacctgggacggcagactgagcgtgatcggcaccggcaccaaggtgaccgtgctg

SEQ ID NO: 33130 - RNA, 333 nt, synthetic construct
  misc_feature 1..333: note = derived and/or modified sequence opt4 from anti-HIV_059-002618_VR-Chain
  source 1..333: mol_type = other RNA
cagctggtgctgacccagccccccagcgtgagcgccgcccccggccagaaggtgaccatcagctgcagcggcagcagcagcaacatcggcaacaacttcgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagactgagcgccggcggcgtgttcggcaccggcaccaaggtgaccgtgctg

SEQ ID NO: 33131 - RNA, 324 nt, synthetic construct
  misc_feature 1..324: note = derived and/or modified sequence opt4 from anti-HIV_059-001522_VR-Chain
  source 1..324: mol_type = other RNA
cagagcgtgctgacccagccccccagcgtgagcgccgcccccggccagaaggtgaccatcagctgcagcggcagcaacagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcggcacctgggacggcagactgagcgtgatcggcgccggcaccaaggtgatcgtggtg

SEQ ID NO: 33132 - RNA, 333 nt, synthetic construct
  misc_feature 1..333: note = derived and/or modified sequence opt4 from anti-HIV_059-000731_VR-Chain
  source 1..333: mol_type = other RNA
cagagcgtgctgacccagccccccagcgtgagcgccgcccccggccagaaggtgaccatcagctgcagcggcagcaccagcaacatcggcaacaagtacgtgagctggtaccagcaggtgcccggcaccgcccccaagctgctgatctacgagaacaacagaagacccagcggcatccccgacagattcagcggcagcaagagcggcaccagcgccaccctggccatcaccggcctgcagaccggcgacgaggccgactactactgcggcacctgggacgccagcctgagaaccggcggcgtgatcggcaccggcaccaaggtgaccgtgctg

SEQ ID NO: 33133 - RNA, 333 nt, synthetic construct
  misc_feature 1..333: note = derived and/or modified sequence opt4 from anti-HIV_059-000634_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacgtgagctggtaccaggtggtgcccggcaccgcccccaagctgctgatctacaagatcaacgagagacccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggccccggcaccaaggtgaccgtgctg

SEQ ID NO: 33134 - RNA, 333 nt, synthetic construct
  misc_feature 1..333: note = derived and/or modified sequence opt4 from anti-HIV_048-250757_VR-Chain
  source 1..333: mol_type = other RNA
cagagcgtgctgacccagccccccagcgtgagcggcgcccccggccagagagtgaccatcagctgcaccggcaccaccagcaacatcggcagcaactacgtggcctggtaccagcagctgcccggcaccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33135 - RNA, 333 nt, synthetic construct
  misc_feature 1..333: note = derived and/or modified sequence opt4 from anti-HIV_048-250716_VR-Chain
  source 1..333: mol_type = other RNA
cagagcgtgctgacccagccccccagcgtgagcgccgcccccggccagaaggtgaccatcagctgcagcggcagcagcagcaacatcggcaacaagtacgtgagctggtaccagcagctgcccggcaccgcccccaagctgctgatctacgagaacagcaagagacccagcggcatccccgacagattcagcggcagcaagagcggcaccagcgccaccctgggcatcaccggcctgcagaccggcggccaggccgactactactgcggcacctgggacaccagcctgagcgccggcggcgtgttcggcagcggcaccaaggtgaccgtgctg

SEQ ID NO: 33136 - RNA, 333 nt, synthetic construct
  misc_feature 1..333: note = derived and/or modified sequence opt4 from anti-HIV_048-250463_VR-Chain
  source 1..333: mol_type = other RNA
cagagcgtgctgacccagccccccagcgtgagcgccgcccccggccagaaggtgaccatcagctgcagcggcagcagaagcaacaacggcaacaactacgtgagctggtaccagcagctgcccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcggcacctgggacagcagcctgagcggcggcggcgtgatcggcaccggcaccaagctgaccgtgctg

SEQ ID NO: 33137 - RNA, 333 nt, synthetic construct
  misc_feature 1..333: note = derived and/or modified sequence opt4 from anti-HIV_048-248153_VR-Chain
  source 1..333: mol_type = other RNA
cagagcgccctgacccagcccgccagcgtgagcgccagcttcggccagagcatcaccatcagctgcaccggcgccgccagcgacgtgggctacaactacgtgagctggtaccagcagctgcccggcaccacccccaagctgctgatctacagaaacaaccagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33138 - RNA, 333 nt, synthetic construct
  misc_feature 1..333: note = derived and/or modified sequence opt4 from anti-HIV_048-247532_VR-Chain
  source 1..333: mol_type = other RNA
cagagcgtgctgacccagccccccagcgtgagcgccgcccccggccagcaggtgaccatcagctgcagcggcaccaccagcaacatcggcaccaactacgtgagctggtaccagcagatgccccccgccgcccccaagctgctgatctacgacaacaagaagagacccagcgacatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33139 - RNA, 333 nt, synthetic construct
  misc_feature 1..333: note = derived and/or modified sequence opt4 from anti-HIV_048-245846_VR-Chain
  source 1..333: mol_type = other RNA
cagagcgtgctgacccagccccccagcgtgagcgccacccccggccagagagtgaccatcagctgcaccggcagcagcagcaacatcggcggctacgacgtgagctggtaccaggtgctgcccggcaccgcccccaagctgctgatctacgacagcgacaagagacccagcggcatccccgacagattcagcggcagccagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33140 - RNA, 333 nt, synthetic construct
  misc_feature 1..333: note = derived and/or modified sequence opt4 from anti-HIV_048-244016_VR-Chain
  source 1..333: mol_type = other RNA
cagagcgtgctgacccagccccccagcgtgagcggcgcccccggccagagagtgaccatcagctgcaccggcagcagcagcaacatcggcggctacgacgtgcactggtaccagcagctgcccggcaccgcccccaagctgctgatctacaagaacgacaagagacccagcggcatccccgacagattcagcggcagcaagagcggcaccagcgccatcctgggcatcaccggcctgcagaccggcgacgaggccgactactactgcggcgcctgggacaccagcctgagcgccggcggcgtgttcggcaccggcaccaaggtgaccgtgctg

SEQ ID NO: 33141 - RNA, 333 nt, synthetic construct
  misc_feature 1..333: note = derived and/or modified sequence opt4 from anti-HIV_048-243682_VR-Chain
  source 1..333: mol_type = other RNA
cagagcctgctgacccagccccccagcgtgagcgccgcccccggccagaaggtgaccatcagctgcaccggcagcagcagcaacatcggcggctacgacgtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33142 - RNA, 333 nt, synthetic construct
  misc_feature 1..333: note = derived and/or modified sequence opt4 from anti-HIV_048-243588_VR-Chain
  source 1..333: mol_type = other RNA
cagagcctgctgacccagccccccagcgtgagcgccccccccggccagatggtgagcatcagctgcagcggcagcagccacaacatcggcgacaactacgtgagctggtaccagcacctgcccggcaccgcccccaagctgctgatctacgacaacaacagcagacccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33143 - RNA, 333 nt, synthetic construct
  misc_feature 1..333: note = derived and/or modified sequence opt4 from anti-HIV_048-241775_VR-Chain
  source 1..333: mol_type = other RNA
cagagcgtgctggcccagccccccagcgtgagcggcgcccccggccagagagtgaccatcagctgcaccggcagcagcagcaacatcggcgagtacgacgtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33144 - RNA, 333 nt, synthetic construct
  misc_feature 1..333: note = derived and/or modified sequence opt4 from anti-HIV_048-237996_VR-Chain
  source 1..333: mol_type = other RNA
cagagcgtgctgacccagccccccagcgtgagcggcgcccccggccagagagtgaccatcagctgcaccggcagcagcagcaacatcggcggctacgacgtgcactggtacagacagctgcccggcaccgcccccaagctgctgatctacgacaccgtgaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33145 - RNA, 330 nt, synthetic construct
  misc_feature 1..330: note = derived and/or modified sequence opt4 from anti-HIV_048-237730_VR-Chain
  source 1..330: mol_type = other RNA
agcgtgctgacccagccccccagcgtgagcggcgcccccggccagagagtgaccatcagctgcaccggcaccaacagcaacttcggcagcaactacgcccactggtaccagcaggtgcccggcaccgcccccaagctgctgatctacagcaacaacgccagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33146 - RNA, 333 nt, synthetic construct
  misc_feature 1..333: note = derived and/or modified sequence opt4 from anti-HIV_048-237253_VR-Chain
  source 1..333: mol_type = other RNA
cagagcgtgctgacccagccccccagcgtgagcgccgcccccggccagaaggtgaccgtgagctgcagcggcagcagcagcaacatcggcagcaacgacgtgagctggtaccagcagttccccggcgccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33147 - RNA, 333 nt, synthetic construct
  misc_feature 1..333: note = derived and/or modified sequence opt4 from anti-HIV_048-234100_VR-Chain
  source 1..333: mol_type = other RNA
cagagcatgctgacccagccccccagcgtgagcgccgcccccggcgagaaggtgaccatcagctgcagcggcagcagcagcaacatcggcaagaccttcgtgagctggtaccagcaggtgcccggcaccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33148 - RNA, 333 nt, synthetic construct
  misc_feature 1..333: note = derived and/or modified sequence opt4 from anti-HIV_048-230882_VR-Chain
  source 1..333: mol_type = other RNA
cagagcgtgctgacccagccccccagcgtgagcgccgcccccggccagaaggtgaccatcagctgcagcggcaacagcagcaacatcggcagcaacttcgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagccccggcggcgtgttcggcaccggcaccaaggtgaccgtgctg

SEQ ID NO: 33149 - RNA, 333 nt, synthetic construct
  misc_feature 1..333: note = derived and/or modified sequence opt4 from anti-HIV_048-229473_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagttccccggcaccgcccccaagctgctgatctacgagaacaacaagagacccagcggcatccccgacagattcagcggcagcaagagcggcaccaccgccaccctggccatcaccagactgcagaccggcgacgaggccgactactactgcggcacctggggcggcagcctgagcgccggcggcgtgttcggcaccggcaccaaggtgaccgtgctg

SEQ ID NO: 33150 - RNA, 333 nt, synthetic construct
  misc_feature 1..333: note = derived and/or modified sequence opt4 from anti-HIV_048-228238_VR-Chain
  source 1..333: mol_type = other RNA
cagagcgtgctgacccagccccccagcgtgagcgccgcccccggccagaaggtgaccatcagctgcagcggcagcagcagcaacatcggcatcaactacgtgagctggtaccagcagctgcccggcaccgcccccaagctgctgatctacgacaacaccaagagaccccagggcatccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33151 - RNA, 333 nt, synthetic construct
  misc_feature 1..333: note = derived and/or modified sequence opt4 from anti-HIV_048-228027_VR-Chain
  source 1..333: mol_type = other RNA
cagagcctgctgacccagagccccagcgccagcggcccccccggccagagagtgaccatcagctgcagcggcagcaacagcaacatcggcagcaacaccgtgaactggtaccaccacctgcccggcgccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33152 - RNA, 333 nt, synthetic construct
  misc_feature 1..333: note = derived and/or modified sequence opt4 from anti-HIV_048-227795_VR-Chain
  source 1..333: mol_type = other RNA
cagagcgtgctgacccagccccccagcgtgagcgccgcccccggccagaaggtgaccatcagctgcagcggcagcagcagcaacatcgagagcagaagcgtgcactggtaccagcagaagcccggccaggcccccgtgctggtgatctactacgacagcgacagacccagcggcatccccgacagattcagcggcagcaagagcggcaccgccgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33153 - RNA, 333 nt, synthetic construct
  misc_feature 1..333: note = derived and/or modified sequence opt4 from anti-HIV_048-227770_VR-Chain
  source 1..333: mol_type = other RNA
cagagcgtgctgacccagccccccagcgtgagcggcgcccccggccagagagtgaccatcagctgcaccggcagcagcagcaacatcggccccagagacgtgcactggtaccagcagctgcccggcaccgtgcccaagctgctgatctacgacacctacaccagacccagcggcatccccgacagattcagcggcagcaagagcggcgccagcgccaccctggacatcaccggcctgcagaccggcgacgaggccgactactactgcggcatctgggacaccagcctgagcgccggcggcgtgttcggcaccggcaccaaggtgaccgtgctg

SEQ ID NO: 33154 - RNA, 333 nt, synthetic construct
  misc_feature 1..333: note = derived and/or modified sequence opt4 from anti-HIV_048-225298_VR-Chain
  source 1..333: mol_type = other RNA
cagagcgccctgacccagcccagaagcgtgagcggcagccccggccagagcgtgaccatcagctgcaccggcaccagcaacgacgtgggctacgactacgtgagctggtaccagcagctgcccggcaccgcccccaagctgctgatctacgacatcaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33155 - RNA, 327 nt, synthetic construct
  misc_feature 1..327: note = derived and/or modified sequence opt4 from anti-HIV_048-225090_VR-Chain
  source 1..327: mol_type = other RNA
gagctgacccagccccccagcgtgagcggcgcccccggccagagagtgaccatcagctgcaccggcagcagcagcaacatcggcggctacgacgtgcactggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33156 - RNA, 333 nt, synthetic construct
  misc_feature 1..333: note = derived and/or modified sequence opt4 from anti-HIV_048-224187_VR-Chain
  source 1..333: mol_type = other RNA
cagagcgtgctgacccagccccccagcgccagcggcacccccggccagagagtgaccatcagctgcagcggcagcagcgccaacatcggcaccaactacgtgttctggtaccagcacctgcccggcaccacccccagactgctgatcttcagaaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33157 - RNA, 333 nt, synthetic construct
  misc_feature 1..333: note = derived and/or modified sequence opt4 from anti-HIV_048-223055_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagttccccggcaccgcccccaaggtgctgatctacggcaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33158 - RNA, 333 nt, synthetic construct
  misc_feature 1..333: note = derived and/or modified sequence opt4 from anti-HIV_048-222711_VR-Chain
  source 1..333: mol_type = other RNA
cagcccgtgctgacccagccccccagcgtgagcggcgcccccggccagagagtgaccatcagctgcaccggcagcagcagcaacatcggcggctacgacgtgcactggtaccagcaggtgcccggcaccgcccccaagctgctgatcttcgagaacaacagaagacccagcggcatccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33159 - RNA, 333 nt, synthetic construct
  misc_feature 1..333: note = derived and/or modified sequence opt4 from anti-HIV_048-221209_VR-Chain
  source 1..333: mol_type = other RNA
cagagcgtgctgacccagccccccagcgtgagcggcgcccccggccagagagtgaccatcagctgcaccggcaacagcagcaacatcggcgactacgacgtgcactggtaccagcaggtggccggcaccgcccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33160 - RNA, 333 nt, synthetic construct
  misc_feature 1..333: note = derived and/or modified sequence opt4 from anti-HIV_048-220629_VR-Chain
  source 1..333: mol_type = other RNA
cagagcgccctgacccagcccgccagcgtgagcggcagcctgggccagagcatcaccatcagctgcaccggcaccagcagagacgtgggctacagctacgtgagctggtaccagcacctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33161 - RNA, 333 nt, synthetic construct
  misc_feature 1..333: note = derived and/or modified sequence opt4 from anti-HIV_048-219430_VR-Chain
  source 1..333: mol_type = other RNA
cagagcgtgctgacccagccccccagcgtgagcgccgcccccggccagatggtgaccatcagctgcagcggcagcaccagcaacatcggcatcaactacgtgagctggtaccagcacgtgcccggcaccgcccccaagctgctgatctacgacaacaacaagagacccagcggcatccccgacagattcagcggcagcaagagcggcaccagcgccaccctgggcatcaccggcctgcacaccggcgacgaggccgactactactgcggcacctgggacaccagcctgagcgccggcggcgtgttcggcaccggcaccaaggtgaccgtgctg

SEQ ID NO: 33162 - RNA, 333 nt, synthetic construct
  misc_feature 1..333: note = derived and/or modified sequence opt4 from anti-HIV_048-216250_VR-Chain
  source 1..333: mol_type = other RNA
cagagcgtgctgacccagccccccagcgtgagcgccgcccccggccagaaggtgaccatcagctgcaccggcaccaccagcgacttcggctacaactgcgtgagctggtaccagcagcaccccggcagagcccccaaggtgatcatcagcggcgtgaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33163 - RNA, 321 nt, synthetic construct
  misc_feature 1..321: note = derived and/or modified sequence opt4 from anti-HIV_048-216133_VR-Chain
  source 1..321: mol_type = other RNA
acccagccccccagcctgagcgccacccccggccagagagtgagcatcagctgcagcggcggcggcagcaacatcggcaacaacgacgtgttctggttccagcagttccccggcgccggccccagactgctgatctacgacaaccacaagagacactacggcacccccgacagattcagcggcagcaagagcggcaccagcgccaccctggccatcaccggcctgcagaccggcgacgaggccgcctactactgcggcacctgggacggcagcctgagcaccggcggcgtgatcggcaccggcaccaaggtgaccgtgctg

SEQ ID NO: 33164 - RNA, 333 nt, synthetic construct
  misc_feature 1..333: note = derived and/or modified sequence opt4 from anti-HIV_048-214886_VR-Chain
  source 1..333: mol_type = other RNA
cagagcgccctgacccagcccagaagcgtgagcggcagccccggccagagcgtgaccatcagctgcaccggcaccagcagcgacgtgggctacaactacgtgagctggtaccagcaccaccccggcaccgcccccaagctgctgatctacaagaacaacaacagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33165 - RNA, 333 nt, synthetic construct
  misc_feature 1..333: note = derived and/or modified sequence opt4 from anti-HIV_048-214709_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacgacagaagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33166 - RNA, 333 nt, synthetic construct
  misc_feature 1..333: note = derived and/or modified sequence opt4 from anti-HIV_048-214001_VR-Chain
  source 1..333: mol_type = other RNA
cagagcgtgctgacccagccccccagcgtgagcggcgcccccggccagaccgtgaccatcagctgcagcggcagcaacagcaacatcggcaaccacgacgtgcactggtaccagcacgtgcccggcaccgcccccaagctgctgatctacgacaacaacaagagacccagcggcatccccgacagattcagcggcagcaagagcggcaccagcgccaccctgggcatcaccggcctgcagaccggcgacgaggccgagtactactgcgccacctgggacgccagcctgagcggcggcggcgtgttcagaaccggcaccaaggtgaccgtgctg

SEQ ID NO: 33167 - RNA, 333 nt, synthetic construct
  misc_feature 1..333: note = derived and/or modified sequence opt4 from anti-HIV_048-213230_VR-Chain
  source 1..333: mol_type = other RNA
cagagcgtgctgacccagccccccagcatgagcgccgcccccggccagaaggtgaccatcagctgcagcggcagcagcaacaacatcggcaagaacgtggtgagctggtaccagcagctgcccggcaccgcccccaaggtgctgatctacgagaacaacaagagactgagcggcatccccgacagattcagcggcagcaagagcggcaccagcgccaccctggtgatcaccggcctgcagaccggcgacgaggccgactactactgcggcacctgggacagcagcctgagcgccggcggcgtgttcggcaccggcaccaaggtgaccgtgctg

SEQ ID NO: 33168 - RNA, 333 nt, synthetic construct
  misc_feature 1..333: note = derived and/or modified sequence opt4 from anti-HIV_048-212574_VR-Chain
  source 1..333: mol_type = other RNA
cagagcgtgctgacccagccccccagcgtgagcgccgcccccggccagagagtgaccgtgagctgcagcggcagcaccagcaacatcgagagcaactacgtgagctggtaccagcaggtgcccggcaccgcccccaagctgctgatctacgagaacaacaagagacccagcggcatccccgacagattcagcggcagcaagagcggcaccagcgccaccctggccatcaccggcctgcagaccggcgacgaggccgcctactactgcggcacctgggacggcagcctgagcaccggcggcgtgatcggcaccggcaccaaggtgaccgtgctg

SEQ ID NO: 33169 - RNA, 333 nt, synthetic construct
  misc_feature 1..333: note = derived and/or modified sequence opt4 from anti-HIV_048-212207_VR-Chain
  source 1..333: mol_type = other RNA
cagagcgtgctgacccagccccccagcctgagcgccgcccccggccagaaggtgaccatcagctgcagcggcggcagcagcaacatcggcaacaactacgtgagctggtaccagcacctgcccggcaccgcccccaagctgctgatctacgacaactacaagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33170 - RNA, 333 nt, synthetic construct
  misc_feature 1..333: note = derived and/or modified sequence opt4 from anti-HIV_048-209146_VR-Chain
  source 1..333: mol_type = other RNA
cagagcgtgctgacccagccccccagcgtgagcggcgcccccggccagaagatcaccgtgagctgcaccggcaccaccagcaacatcggcccccacgacgtgcactggtaccagctggtgcccggcagaccccccaagctgctgatcttccacaacaacatcagacccagcggcatccccgacagattcagcggcagcaagagcggcatgagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33171 - RNA, 333 nt, synthetic construct
  misc_feature 1..333: note = derived and/or modified sequence opt4 from anti-HIV_048-208206_VR-Chain
  source 1..333: mol_type = other RNA
cagagcgtgctgacccagccccccagcgtgagcgccgcccccggccagaaggtgaccatcagctgcagcggcagcagcagcaacatcggcagcaactacgtgagctggtaccagcagttccccggcaccgcccccagactgctgatctacgagaacgacaagagacccagcgccatccccgacagattcagcggcagcaagagcggcaccagcgccaccctgggcatcaccggcctgcacaccggcgacgaggccgactactactgcggcacctgggacggcagcctgagcaccggcggcgtgatcggcaccggcaccaaggtgaccgtgctg

SEQ ID NO: 33172 - RNA, 333 nt, synthetic construct
  misc_feature 1..333: note = derived and/or modified sequence opt4 from anti-HIV_048-208194_VR-Chain
  source 1..333: mol_type = other RNA
cagagcgccctgacccagccccccagcgccagcggcagccccggccagagcgtgaccatcagctgcaccggcaccagcagcgacatcggctacaagtacgtgagctggtaccagctgctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcggcgcctgggacaccagcctgagcgccggcggcgtgttcggcaccggcaccaaggtgaccgtgctg

SEQ ID NO: 33173 - RNA, 333 nt, synthetic construct
  misc_feature 1..333: note = derived and/or modified sequence opt4 from anti-HIV_048-207744_VR-Chain
  source 1..333: mol_type = other RNA
cagagcgccctgacccagcccgccagcgtgagcgccagcttcggccagagcatcaccatcagctgcaccggcgccgccagcaccatcggcaacaacctggtgagctggtacagactgctgcccggcaccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33174 - RNA, 333 nt, synthetic construct
  misc_feature 1..333: note = derived and/or modified sequence opt4 from anti-HIV_048-206501_VR-Chain
  source 1..333: mol_type = other RNA
cagagcgtgctgacccagccccccagcgtgagcggcgcccccggccagagagtgaccatcagctgcagcggcagcagcagcaacatcggcaacaacgccgtgaactggtaccagcagctgcccggcaaggcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33175 - RNA, 333 nt, synthetic construct
  misc_feature 1..333: note = derived and/or modified sequence opt4 from anti-HIV_048-204221_VR-Chain
  source 1..333: mol_type = other RNA
cagagcgtgctgacccagccccccagcgccagcggcacccccggccagagagtgaccatcagctgcttcggcagcagcagcaacatcgccagcagcgccgtgaactggtaccagcagctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33176 - RNA, 333 nt, synthetic construct
  misc_feature 1..333: note = derived and/or modified sequence opt4 from anti-HIV_048-204015_VR-Chain
  source 1..333: mol_type = other RNA
cagagcgtgctgacccagccccccagcgccagcggcacccccggccagagagtgaccatcagctgcagcggcagcagcagcaacatcggcagcaagtacgtgtactggtaccagcagctgcccggcaccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33177 - RNA, 333 nt, synthetic construct
  misc_feature 1..333: note = derived and/or modified sequence opt4 from anti-HIV_048-201240_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtggcctggtaccagcagctgcccggcaccgcccccaagctgctgatcaaggagaacagccagagacccagcggcatccccgacagattcagcggcagcaagagcggcaccagcgccaccctggccatcaccggcctgcagaccggcgacgaggccgactactactgcggcacctgggacaccagcctgagcaccggcggcgtgttcggcaccggcaccaaggtgaccgtgctg

SEQ ID NO: 33178 - RNA, 333 nt, synthetic construct
  misc_feature 1..333: note = derived and/or modified sequence opt4 from anti-HIV_048-200455_VR-Chain
  source 1..333: mol_type = other RNA
cagagcgccctgacccagcccgccagcgtgagcggcagccccggccagagcatcaccatcagctgcaccggcaccagcagcgacgtgggctacaactacgtgagctggtaccaggtgctgcccggcaccgcccccaagctgctgatctacaagaacaccgagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33179 - RNA, 333 nt, synthetic construct
  misc_feature 1..333: note = derived and/or modified sequence opt4 from anti-HIV_048-200319_VR-Chain
  source 1..333: mol_type = other RNA
cagagcgtggtgacccagccccccagcgccagcggcacccccggccagagagtgaccatcagctgcagcggcagcagcagcaacatcggcagcaagtacgtgtactggtaccaccagcaccccggcaccgcccccaagctgctgatctacgacaacaacaacagacccagcggcatccccgacagattcagcggcagcaagagcggcaccagcgccaccctgggcatcaccggcctgcagaccggcgacgaggccgactactactgcggcacctgggacaccagcctgagcagaggcggcgtgttcggcaccggcaccaaggtgaccgtgctg

SEQ ID NO: 33180 - RNA, 333 nt, synthetic construct
  misc_feature 1..333: note = derived and/or modified sequence opt4 from anti-HIV_048-197896_VR-Chain
  source 1..333: mol_type = other RNA
cagagcgtgctgacccagccccccagcgtgagcgccgcccccggccagaaggtgaccatcagctgcagcggcgccagctacaacatcggcaagaacagcgtgagctggtaccagcagctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33181 - RNA, 333 nt, synthetic construct
  misc_feature 1..333: note = derived and/or modified sequence opt4 from anti-HIV_048-193813_VR-Chain
  source 1..333: mol_type = other RNA
cagagcgtgctgacccagagccccagcgtgagcgccgcccccggccagaaggtgaccatcagctgcagcggcagcaacagcaacgtgggcaactactacgtgagctggtaccagcacctgcccggcaccgcccccaaggtgctgatctacgagggcaacaagagacccagcggcgtgcccgacagattcagcggcagcaagagcggcaccagcgccagcctggccatcaccggcctgcagaccggcgacgaggccgactactactgcggcacctgggacaccagcctgagcgccggcggcgtgttcggcagcggcaccaaggtgaccgtgctg

SEQ ID NO: 33182 - RNA, 333 nt, synthetic construct
  misc_feature 1..333: note = derived and/or modified sequence opt4 from anti-HIV_048-192098_VR-Chain
  source 1..333: mol_type = other RNA
cagagcgtgctgacccagccccccagcgccagcggcacccccggccagagagtgaccatcagctgcagcggcagcaccagcaacatcggcagcaactacgtgtactggtaccagcagctgcccggcaccacccccaagctgctgatctacgagaacaacaagagacccagcggcatcaccgacagattcttcggcagcaagagcggccccagcgccaccctggacatcaccggcctgcagaccggcgacgaggccgactactactgcggcacctgggacgccagcctgagcgccggcggcgtgttcggcaccggcaccaaggtgaccgtgctg

SEQ ID NO: 33183 - RNA, 333 nt, synthetic construct
  misc_feature 1..333: note = derived and/or modified sequence opt4 from anti-HIV_048-191786_VR-Chain
  source 1..333: mol_type = other RNA
cagagcgtgctgacccagccccccagcgtgagcgccgcccccggccagaacgtgaacatcagctgcagcggcagcagcagcaacatcgagaacaacttcgtgagctggtaccagaagctgcccggcaccgcccccaagctgctgatctacgacaacaacaagagacccagcggcatcagagacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33184 - RNA, 333 nt, synthetic construct
  misc_feature 1..333: note = derived and/or modified sequence opt4 from anti-HIV_048-188746_VR-Chain
  source 1..333: mol_type = other RNA
cagagcgtgctgacccagccccccagcgccagcggcacccccggccagaaggtgaccatcagctgcagcggcagcaacagcaacatcggcagcaacttcgtgagctggtaccagctgctgcccggcaccacccccaagctgctgatctacagaaacaaccagagacccagcggcgtgcccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33185 - RNA, 333 nt, synthetic construct
  misc_feature 1..333: note = derived and/or modified sequence opt4 from anti-HIV_048-185937_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatcccctaccccatcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33186 - RNA, 333 nt, synthetic construct
  misc_feature 1..333: note = derived and/or modified sequence opt4 from anti-HIV_048-184849_VR-Chain
  source 1..333: mol_type = other RNA
cagagcgtgctgacccaggcccccagcgccagcggcacccccggccagaccgtgaccatcagctgcagcggcagcagcagcaacatcggcaccaagtacgtgtactggtaccagcagctgcccggcaccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagccccggcggcgtgttcggcaccggcaccaaggtgaccgtgctg

SEQ ID NO: 33187 - RNA, 333 nt, synthetic construct
  misc_feature 1..333: note = derived and/or modified sequence opt4 from anti-HIV_048-183089_VR-Chain
  source 1..333: mol_type = other RNA
cagagcgtgctgacccagccccccagcgccagcggcacccccggccagagagtgaccatcagctgcagcggcagcagcagcaacatcggcagcagctacgtgtactggtaccagctgctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33188 - RNA, 333 nt, synthetic construct
  misc_feature 1..333: note = derived and/or modified sequence opt4 from anti-HIV_048-181509_VR-Chain
  source 1..333: mol_type = other RNA
cagagcgtgctgacccagccccccagcgtgagcggcgcccccggccagagagtgaccatcagctgcaccggcagcagcagcaacatcggcggctacgacgtgcactggtaccaccagctgcccggcgccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33189 - RNA, 333 nt, synthetic construct
  misc_feature 1..333: note = derived and/or modified sequence opt4 from anti-HIV_048-180990_VR-Chain
  source 1..333: mol_type = other RNA
cagagcgtgctgacccagccccccagcgtgagcgccgcccccggccagagagtgaccatcagctgcagcggcagcaccagcaacatcggcaacaactacgtgagctggtaccagcacttccccggcaaggtgcccaaggtggtgatcagcgagaccaccaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33190 - RNA, 333 nt, synthetic construct
  misc_feature 1..333: note = derived and/or modified sequence opt4 from anti-HIV_048-177532_VR-Chain
  source 1..333: mol_type = other RNA
cagagcgccctgacccagccccccagcgccagcggcagcctgggccagagcgtgaccatcagctgcaccggcaccagcagcgacgtgggcaacaacttcgtgagctggtaccagaagaagcccggcaaggcccccaagctgatcgtgtacgaggtgaacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33191 - RNA, 324 nt, synthetic construct
  misc_feature 1..324: note = derived and/or modified sequence opt4 from anti-HIV_048-177426_VR-Chain
  source 1..324: mol_type = other RNA
ctgacccagccccacagcgtgagcgagagccccggcaagaccgtgaccatcagctgcaccggcaccagcagcgacgtgggctacaactacgtgagctggtaccagcaccaccccggcaaggcccccaagctgctgatctacgaggtgaccaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33192 - RNA, 333 nt, synthetic construct
  misc_feature 1..333: note = derived and/or modified sequence opt4 from anti-HIV_048-177389_VR-Chain
  source 1..333: mol_type = other RNA
cagagcgtgctgacccagccccccagcatgagcgccgcccccggcgagagagtgaccatcagctgcagcggcagcagcagcaacatcggcaaccaccacgtgagctggtaccagcagagacccggcaccgcccccaagctgctgatctacgagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33193 - RNA, 333 nt, synthetic construct
  misc_feature 1..333: note = derived and/or modified sequence opt4 from anti-HIV_048-174266_VR-Chain
  source 1..333: mol_type = other RNA
cagagcgtgctgacccagccccccagcgtgagcggcgcccccggccagagagtgaccatcagctgcagcggcagcagcagcaacatcggcagccactacgtgagctggtaccagcaggtgcccggcaccgcccccagactggtgatctacgacaccatcaagagacacagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33194 - RNA, 333 nt, synthetic construct
  misc_feature 1..333: note = derived and/or modified sequence opt4 from anti-HIV_048-172847_VR-Chain
  source 1..333: mol_type = other RNA
cagagcgtgctgacccagccccccagcgtgagcgccgcccccggccagagagtgaccgtgagctgcagcggcagcaccagcaacatcgagagcaactacgtgagctggtaccagcaggtgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33195 - RNA, 333 nt, synthetic construct
  misc_feature 1..333: note = derived and/or modified sequence opt4 from anti-HIV_048-172845_VR-Chain
  source 1..333: mol_type = other RNA
cagagcgccctgacccagccccccagcgccagcggcagccccggccagagcgtgaccatcagctgcaccggcaccagcagcgacgtgggctacaactacgtgagctggtaccagcagctgcccggcaccgcccccaagctgctgatctacagaaacaaccagagacccagcggcgtgcccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33196 - RNA, 333 nt, synthetic construct
  misc_feature 1..333: note = derived and/or modified sequence opt4 from anti-HIV_048-172363_VR-Chain
  source 1..333: mol_type = other RNA
cagagcgtgctgacccagccccccagcgtgagcgccgcccccggccagaaggtgaccatcagctgcagcggcagcggcagcaacatcggcaacacctacgtgagctggtaccagcagctgcccggcaccgcccccaagctgctgatcttcgaggacaacaagagacccagcggcatccccgacagattcagcggcagcaagagcggcaccagcgccaccctggccatcaccggcctgcagaccggcgacgaggccgactactactgcggcacctgggacagcagcctgagcggcggcggcgtgatcggcaccggcaccaagctgaccgtgctg

SEQ ID NO: 33197 - RNA, 333 nt, synthetic construct
  misc_feature 1..333: note = derived and/or modified sequence opt4 from anti-HIV_048-171609_VR-Chain
  source 1..333: mol_type = other RNA
cagagcgtgctgacccagccccccagcgtgagcgccgcccccggccaggaggtgaccatcagctgcagcgccagcagcagcagcatcggcaacgacttcgtgagctggtaccagcagctgcccggcaccgcccccaagctgctgatctacggcaacagcaacagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33198 - RNA, 333 nt, synthetic construct
  misc_feature 1..333: note = derived and/or modified sequence opt4 from anti-HIV_048-170705_VR-Chain
  source 1..333: mol_type = other RNA
cagagcgtgctgacccagccccccagcgtgagcgccgcccccggccagatggtgaccatcagctgcagcggcagcaccagcaacatcggcatcaactacgtgagctggtaccagcacgtgcccggcaccgcccccaagctgctgatctacgagaacgtggagagaagaagcggcatccccgacagattcagcgccagcaagagcgccaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33199 - RNA, 333 nt, synthetic construct
  misc_feature 1..333: note = derived and/or modified sequence opt4 from anti-HIV_048-168381_VR-Chain
  source 1..333: mol_type = other RNA
cagagcgccctgacccagcccgccagcgtgagcggcagccccggccagagcatcaccatcagctgcaccggcaccagcagcaacatcggcagcaactacgtgagctggtaccagcagctgcccggcaccgcccccaagctgctgatctacgagaacaaccagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33200 - RNA, 333 nt, synthetic construct
  misc_feature 1..333: note = derived and/or modified sequence opt4 from anti-HIV_048-166619_VR-Chain
  source 1..333: mol_type = other RNA
cagagcgtgctgacccagccccccagcgtgagcggcgcccccggccagagagtgaccatcagctgcaccggcagcagcagcaacatcggcggctaccacacccactggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33201 - RNA, 333 nt, synthetic construct
  misc_feature 1..333: note = derived and/or modified sequence opt4 from anti-HIV_048-162036_VR-Chain
  source 1..333: mol_type = other RNA
cagagcgtgctggcccagccccccagcgtgagcggcgcccccggccagaccgtgaccatcagctgcaccggcagcagcagcaacatcggcggctacgacgtgcactggtaccagcagctgcccggcaccgcccccaagctgctgatctacaaggacgacaagagacccagcggcatccccgacagattcagcggcagcaagagcggcaccagcgccaccctgggcatcaccggcctgcagaccggcgacgaggccgactactactgcggcacctgggacaccagcctgaacagaggcggcgtgttcggcaccggcaccaaggtgaccgtgctg

SEQ ID NO: 33202 - RNA, 333 nt, synthetic construct
  misc_feature 1..333: note = derived and/or modified sequence opt4 from anti-HIV_048-160042_VR-Chain
  source 1..333: mol_type = other RNA
cagagcgtgctgacccagccccccagcgtgagcgccgcccccggccagaaggtgaccatcagctgcagcggcagcagcagcaacatcggcatcaactacatcagctggtaccagcagctgcccggcaccgcccccaagatcctgatctacgacaacgacaagagacccctgggcatccccgacagattcagcggcagcaagagcggcaccagcgccaccctgggcatcaccggcctgcagaccggcgacgaggccgactactactgcggcacctgggacgccagcctgagcgccggcggcgtgttcggcaccggcaccaaggtgaccgtgctg

SEQ ID NO: 33203 - RNA, 333 nt, synthetic construct
  misc_feature 1..333: note = derived and/or modified sequence opt4 from anti-HIV_048-159676_VR-Chain
  source 1..333: mol_type = other RNA
cagagcgtgctgacccagccccccagcgtgagcgccagccccggccagaaggtgaccatcagctgcagcggcagcagcagcgacatcggcagcaactacgtgagctggtacgtgcagctgcccggcaccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33204 - RNA, 333 nt, synthetic construct
  misc_feature 1..333: note = derived and/or modified sequence opt4 from anti-HIV_048-159500_VR-Chain
  source 1..333: mol_type = other RNA
cagagcgtgctgacccagccccccagcgtgagcgccgcccccggccagaacgtgaccatcagctgcagcggcagctggagcaacatcggcgccaactacgtgagctggtaccagcagctgcccggcaccgcccccaagctgctgatctacgagaacaacaagagacccagcggcatccccgacagattcagcggcagcaagagcggcaccagcgccaccctgggcttcaccggcctgcagaccggcgacgaggccgactactactgcggcacctgggacaccagcctgagcgccggcggcgtgttcggcaccggcaccaaggtgaccgtgctg

SEQ ID NO: 33205 - RNA, 333 nt, synthetic construct
  misc_feature 1..333: note = derived and/or modified sequence opt4 from anti-HIV_048-159421_VR-Chain
  source 1..333: mol_type = other RNA
cagagcctgctgacccaggcccccagcgtgagcgccgcccccggccagaccgtgaccatcagctgcagcggcagcaacgccgacatcggcaagaacttcgtgagctggtaccagcagagccccggcgccgcccccaagctgctgatctacgagaacgacagaagacccagcggcatccccgacagattcagcggcagcaagagcggcaccagcgccaccctgggcatcaccggcctgcagaccggcgacgaggccgagtactactgcgccacctgggacgccagcctgagcggcggcggcgtgttcggcaccggcaccaaggtgaccgtgctg

SEQ ID NO: 33206 - RNA, 333 nt, synthetic construct
  misc_feature 1..333: note = derived and/or modified sequence opt4 from anti-HIV_048-159333_VR-Chain
  source 1..333: mol_type = other RNA
cagagcgtgctgacccagccccccagcgccagcggcacccccggccagagagtgaccatcagctgcagcggcagcaacagcaacatcggcagcgacagcgtgtactggtaccagcagctgcccggcagaagccccaagctgctgatctacagaaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33207 - RNA, 333 nt, synthetic construct
  misc_feature 1..333: note = derived and/or modified sequence opt4 from anti-HIV_048-158932_VR-Chain
  source 1..333: mol_type = other RNA
cagagcgtgctgacccagcccgccagcgtgagcggcagccccggccagagcatcaccatcagctgcagcggcagcagcagcaacatcggcgacatcttcgtgagctggtaccagcaggtgcccggcgccgcccccaagctgctgatctacgacaacgacaagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33208 - RNA, 333 nt, synthetic construct
  misc_feature 1..333: note = derived and/or modified sequence opt4 from anti-HIV_048-155811_VR-Chain
  source 1..333: mol_type = other RNA
cagagcgccctgacccagcccgccagcgtgagcggcagccccggccagagcatcaccatcagctgcaccggcaccagcagcgacgtgggctacgactacgtgagctggtaccagctgctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33209 - RNA, 333 nt, synthetic construct
  misc_feature 1..333: note = derived and/or modified sequence opt4 from anti-HIV_048-155464_VR-Chain
  source 1..333: mol_type = other RNA
cagagcgccctgacccagcccgccagcgtgagcggcagccccggccagagcatcaccatcagctgcaccggcgccaccggcgacagcggccacacctacgtgagctggtaccagcagctgcccggcaccgcccccaagctgctgatctacagcaacaacgagagacccagcggcgtgcccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33210 - RNA, 333 nt, synthetic construct
  misc_feature 1..333: note = derived and/or modified sequence opt4 from anti-HIV_048-155392_VR-Chain
  source 1..333: mol_type = other RNA
cagagcgtgctgacccagccccccagcgtgagcgccgcccccggccagatggtgaccatcagctgcagcggcagcagcagcaacatcggcgacaactacgtgagctggtaccagcagctgcccggcagaggccccaagctgctggtgtacgacacctacaagagatacctggagacccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33211 - RNA, 333 nt, synthetic construct
  misc_feature 1..333: note = derived and/or modified sequence opt4 from anti-HIV_048-155389_VR-Chain
  source 1..333: mol_type = other RNA
cagagcgtgctgacccagccccccagcgtgagcgccgcccccggccagaaggtgaccatcagctgcagcggcatcagcagcaacatcggcaacaaccccgtgagctggtaccagcagttccccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33212 - RNA, 333 nt, synthetic construct
  misc_feature 1..333: note = derived and/or modified sequence opt4 from anti-HIV_048-154449_VR-Chain
  source 1..333: mol_type = other RNA
cagagcgtgctgaagcagccccccagcgtgagcggcgcccccggcctgagagtgaccatcagctgcaccggcggcagcagcaacatcggcggcttcgacgtgcactggtaccagcacttccccggcaccgcccccaagctgctgatctacgacaacgaccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33213 - RNA, 333 nt, synthetic construct
  misc_feature 1..333: note = derived and/or modified sequence opt4 from anti-HIV_048-153379_VR-Chain
  source 1..333: mol_type = other RNA
cagagcgtgctgacccagccccccagcgtgagcgccacccccggccagaaggtgaccatcagctgcagcggcagcagaagcaacatcggcagccactacgtgagctggtaccagcagttccccgagagcgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33214 - RNA, 333 nt, synthetic construct
  misc_feature 1..333: note = derived and/or modified sequence opt4 from anti-HIV_048-153171_VR-Chain
  source 1..333: mol_type = other RNA
cagagcgtgctgacccagccccccagcgtgagcgccgcccccggccagaaggtgaccatcagctgcagcggcagcaccagcaacatcgaggacatctacgtgagctggtaccagcacctgcccggcaccgcccccaagctgctgatctacgacaacaacaagagacccagcggcatccccgacagattcagcggcagcaagagcggcaccagcgccaccctggccatcaccggcctgcagaccggcgacgaggccgactactactgcggcacctgggacaccagcctgagcgccggcggcgtgttcggcaccggcaccaaggtgaccgtgctg

SEQ ID NO: 33215 - RNA, 333 nt, synthetic construct
  misc_feature 1..333: note = derived and/or modified sequence opt4 from anti-HIV_048-152324_VR-Chain
  source 1..333: mol_type = other RNA
cagagcatggtgacccagagccccagcgtgagcgccgcccccggccagaaggtgaccatcagctgcagcggcaccagcagcaacatcggccagaactacgtgagctggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33216 - RNA, 333 nt, synthetic construct
  misc_feature 1..333: note = derived and/or modified sequence opt4 from anti-HIV_048-146102_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacatcagctggtaccagctgctgcccggcaccccccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33217 - RNA, 333 nt, synthetic construct
  misc_feature 1..333: note = derived and/or modified sequence opt4 from anti-HIV_048-145984_VR-Chain
  source 1..333: mol_type = other RNA
cagagcgtgctgacccagcccctgagcgtgagcggcgcccccggccagagagtgaccatcagctgcaccggcagcagcagcaacatcggcagcaacttcgtgagctggtaccaggtgctgcccggcaccacccccaagctgctgatcttcaagaacaacgagagacccagcggcatccccgacagattcagcggcagcaagagcggcaccagcgccaccctgggcatcaccggcctgcagaccggcgacgaggccgactactactgcggcgcctgggacaccagcctgagcgccggcggcgtgttcggcaccggcaccaaggtgaccgtgctg

SEQ ID NO: 33218 - RNA, 333 nt, synthetic construct
  misc_feature 1..333: note = derived and/or modified sequence opt4 from anti-HIV_048-145371_VR-Chain
  source 1..333: mol_type = other RNA
cagagcgtgctgacccagccccccagcgtgagcgccgccagcggccagaaggtgagcatcccctgcagcggcggcaccagcaacatcggcgacaactacgtgagctggttccagcagttccccggcagcgcccccaagatcctgatctacgacagcgacaagagacccagcagaatcagcgacagattcagcgccagcaagagcggcaccagcgccaccctggacatcaccagactgcagaccggcgacgaggccgactactactgcggcacctgggacaccagcctgagcgccggcggcgtgttcggcaccggcaccaaggtgaccgtgctg

SEQ ID NO: 33219 - RNA, 333 nt, synthetic construct
  misc_feature 1..333: note = derived and/or modified sequence opt4 from anti-HIV_048-144907_VR-Chain
  source 1..333: mol_type = other RNA
cagagcgccctgacccagcccgccagcgtgagcggcagccccggccagagcatcaccatcagctgcaccggcaccagaagagacgtgggcttcaactacgtgagctggtaccagcagcaccccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33220 - RNA, 333 nt, synthetic construct
  misc_feature 1..333: note = derived and/or modified sequence opt4 from anti-HIV_048-142298_VR-Chain
  source 1..333: mol_type = other RNA
cagagcgtgctgacccagccccccagcgccagcggcacccccggccagagagtgaccatcagctgcagcggcagcagcagcaccatcggcaacaactacatcagctggtaccagctgctgcccggcaccccccccaagctgctgatcttcaagaacaacgagagacccagcggcatccccgacagattcagcgccagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33221 - RNA, 333 nt, synthetic construct
  misc_feature 1..333: note = derived and/or modified sequence opt4 from anti-HIV_048-142277_VR-Chain
  source 1..333: mol_type = other RNA
cagagcgtgctgacccagccccccagcgtgagcggcgcccccggccagagaatcaccatcagctgcaccggcagcagcagcaacatcggcgcctacgacgtgcagtggtaccagcacctgcccggcaccgcccccaagctgctgatctacaagaacaccgagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33222 - RNA, 333 nt, synthetic construct
  misc_feature 1..333: note = derived and/or modified sequence opt4 from anti-HIV_048-141934_VR-Chain
  source 1..333: mol_type = other RNA
cagagcgtgctgacccagccccccagcgtgagcggcgcccccggccagagagtgaccatcagctgcaccggcaacagcagcaacatcggcgcctacgacgtgcactggtaccagcagctgcccggcaccgcccccaagctgatgatctacgaggtgagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33223 - RNA, 333 nt, synthetic construct
  misc_feature 1..333: note = derived and/or modified sequence opt4 from anti-HIV_048-141207_VR-Chain
  source 1..333: mol_type = other RNA
cagagcgtgctgacccagccccccagcgtgagcgccgcccccggccagaaggtgaccatcgcctgcagcggcagcagcagcaacatcggcaacaactacgtgagctggtaccagcagctgcccggcaccgcccccaagctgctgatctacgccaacaacagaagacccagcggcatccccgacagattcagcgccagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33224 - RNA, 333 nt, synthetic construct
  misc_feature 1..333: note = derived and/or modified sequence opt4 from anti-HIV_048-140796_VR-Chain
  source 1..333: mol_type = other RNA
cagagcgtgctgacccagccccccagcgtgagcgccacccccggccagaaggtgaccatcagctgcagcggcaccagaagcaacatcggcaacaactacgtgagctggtacagacagttccccggcaccgcccccaagctgctgatctacgaggacaacaagagacccagcggcatccccgccagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33225 - RNA, 333 nt, synthetic construct
  misc_feature 1..333: note = derived and/or modified sequence opt4 from anti-HIV_048-139893_VR-Chain
  source 1..333: mol_type = other RNA
cagagcgtgctgacccagccccccagcgtgagcgccacccccggccagaaggtgaccttcagctgcagcggcagcagcagcaccatcggcaagaactacgtgagctggtaccaggtgctgcccggcaccgcccccaagctgctgatctacaagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33226 - RNA, 333 nt, synthetic construct
  misc_feature 1..333: note = derived and/or modified sequence opt4 from anti-HIV_048-138820_VR-Chain
  source 1..333: mol_type = other RNA
cagagcgtgctgacccagccccccagcgtgagcggcgcccccggccagaaggtgaccatcagctgcagcggcagcggcagcaacatcggcaacacctacgtgagctggtaccagcacctgcccggcaccgcccccaagctgctgatctacgagaacaacaagagacccagcggcatccccgacagattcagcggcagcaagagcgccaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33227 - RNA, 333 nt, synthetic construct
  misc_feature 1..333: note = derived and/or modified sequence opt4 from anti-HIV_048-135858_VR-Chain
  source 1..333: mol_type = other RNA
cagagcgtgctgacccagccccccagcgccagcggcacccccggccagagagtgaccatcagctgcagcggcagcagcagcaacatcggcagcagctacgtgtactggtaccagcagttccccggcagaagccccagactgctgatctacagaaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33228 - RNA, 333 nt, synthetic construct
  misc_feature 1..333: note = derived and/or modified sequence opt4 from anti-HIV_048-134968_VR-Chain
  source 1..333: mol_type = other RNA
cagagcgtgctgacccagccccccagcgtgagcgccgcccccggccagaaggtgaccatcttctgcagcggcagcagcagcaacatcggcaagaactacgtgagctggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33229 - RNA, 333 nt, synthetic construct
  misc_feature 1..333: note = derived and/or modified sequence opt4 from anti-HIV_048-134312_VR-Chain
  source 1..333: mol_type = other RNA
cagagcgtgctgacccagccccccagcgccagcggcacccccggccagagagtgaccatcagctgcagcggcagcagcagcaacatcggcaacaactacgtgagctggtacagactgctgcccggcaccgcccccaagctgctgatctacaagaacgacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33230 - RNA, 330 nt, synthetic construct
  misc_feature 1..330: note = derived and/or modified sequence opt4 from anti-HIV_048-132253_VR-Chain
  source 1..330: mol_type = other RNA
agcgccctgacccagcccgccagcgtgagcggcagccccggccagagcatcgccatcagctgcaccggcaccagcagcgacgtgggctacgacctggtgagctggtaccagcagcaccccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33231 - RNA, 333 nt, synthetic construct
  misc_feature 1..333: note = derived and/or modified sequence opt4 from anti-HIV_048-130710_VR-Chain
  source 1..333: mol_type = other RNA
cagagcgtgctgacccagccccccagcgtggccggcgcccccggccagagagtgaccatcagctgcaccggcaacaccagcaacatcggcggctacgacgtgcactggtaccagcagctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33232 - RNA, 333 nt, synthetic construct
  misc_feature 1..333: note = derived and/or modified sequence opt4 from anti-HIV_048-128564_VR-Chain
  source 1..333: mol_type = other RNA
cagagcgtgctgacccagccccccagcgccagcggcacccccggccagagagtgaccatcagctgcagcggcagcagcagcaacatcggcagcaacaccgtgaactggtaccagcagctgcccggcaccgcccccaagctgctgatctacaagaacaccgagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33233 - RNA, 333 nt, synthetic construct
  misc_feature 1..333: note = derived and/or modified sequence opt4 from anti-HIV_048-126702_VR-Chain
  source 1..333: mol_type = other RNA
cagagcgtgctgacccagccccccagcgccagcgccgcccccggccagagagtgaccatcagctgcagcggcagcaacagcaacatcggcaacaactacgtgagctggtaccagcagctgcccggcaccgcccccaagctgctgatctacgacaacagcaagagacccagcggcatccccgacagattcagcgccagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33234 - RNA, 333 nt, synthetic construct
  misc_feature 1..333: note = derived and/or modified sequence opt4 from anti-HIV_048-124521_VR-Chain
  source 1..333: mol_type = other RNA
cagagcgtgctgacccagccccccagcgtgagcggcgcccccggccagagagtgaccatcagctgcaccggcagcagcagcaccttcggcggctacgacgtgtactggtaccagcagatccccggcaccgcccccaagctgctgatctacgagaacaacaagagacccagcggcatccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33235 - RNA, 333 nt, synthetic construct
  misc_feature 1..333: note = derived and/or modified sequence opt4 from anti-HIV_048-122740_VR-Chain
  source 1..333: mol_type = other RNA
cagagcgtgctgacccagccccccagcatgagcgccgcccccggccagagcgtgaccatcagctgcagcggcagcaccttcaacatcgagaagcaccaggtgacctggctgagacacctgcccggcaccgcccccaccagcgtgatcatcatgaacagccagagacccagcggcacccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33236 - RNA, 327 nt, synthetic construct
  misc_feature 1..327: note = derived and/or modified sequence opt4 from anti-HIV_048-119536_VR-Chain
  source 1..327: mol_type = other RNA
gagctgacccagagccccagcgtgagcgccgcccccggcgagaaggtgaccatcagctgcagcggcaccaacagcaacatcggctactactacgtgagctggtaccagcagttccccggcaccgcccccaaggtggtgatctacgagaacaccaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33237 - RNA, 333 nt, synthetic construct
  misc_feature 1..333: note = derived and/or modified sequence opt4 from anti-HIV_048-116929_VR-Chain
  source 1..333: mol_type = other RNA
cagagcgtgctgacccagccccccagcgtgagcggcgcccccggccagagagtgaccatcagctgcaccggcagcagcagcaacatcggcgactacgacgtgcactggtaccagcagctgcccggcaccgcccccaagctgctgatctacagaaacaaccagagacccagcggcgtgcccgacagattcagcggcagcaagagcggcaccagcgccaccctgggcatcaccggcctgcagaccggcgacgaggccgactactactgcggcacctgggacgccagcctgagcgccggcggcgtgttcggcaccggcaccaaggtgaccgtgctg

SEQ ID NO: 33238 - RNA, 333 nt, synthetic construct
  misc_feature 1..333: note = derived and/or modified sequence opt4 from anti-HIV_048-116577_VR-Chain
  source 1..333: mol_type = other RNA
cagagcgtgctgacccagccccccagcgccagcggcacccccggccagagagtgaccatcagctgcagcggcagcagcagcaacatcggcagcaactacgtgagctggtaccaggtgctgcccggcaccgcccccaagctgctgatctacaagaacaacaagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33239 - RNA, 333 nt, synthetic construct
  misc_feature 1..333: note = derived and/or modified sequence opt4 from anti-HIV_048-116046_VR-Chain
  source 1..333: mol_type = other RNA
cagagcgtgctgacccagccccccagcgtgagcggcgcccccggccagagagtgaccatcagctgcaccggcagcagcagcaacatcggcggctacgacgtgcactggtaccagcagttccccggcaccgcccccaagctgctgatctacgacaacgacaagagacccagcggcatccccgacagattcagcggcagcaagagcggcaccagcgccaccctgggcatcaccggcctgcagaccggcgacgaggccaactactactgcggcgcctgggacaccagcctgagcgccggcggcgtgttcggcaccggcaccaaggtgaccgtgctg

SEQ ID NO: 33240 - RNA, 333 nt, synthetic construct
  misc_feature 1..333: note = derived and/or modified sequence opt4 from anti-HIV_048-115875_VR-Chain
  source 1..333: mol_type = other RNA
cagagcgtgctgacccagccccccagcgtgagcgccgcccccggccagagagtgaccgtgagctgcagcggcagcagcagcaacatcggcaacaacttcgtgagctggtaccagcacctgcccggcaccgcccccaagctgctgatctacgacaacagcaacagacccagcggcatccccgacagattcagcggcagcaagagcggcaccagcgccaccctgggcatcaccggcctgcacaccggcgacgaggccgactactactgcggcacctgggacaccagcctgagcgccggcggcgtgttcggcagcggcaccaaggtgaccgtgctg

SEQ ID NO: 33241 - RNA, 333 nt, synthetic construct
  misc_feature 1..333: note = derived and/or modified sequence opt4 from anti-HIV_048-115599_VR-Chain
  source 1..333: mol_type = other RNA
cagagcgtgctgacccagccccccagcgtgagcgccgcccccggccagatggtgaccatcagctgcagcggcagcagcagcaacatcggcagccacagcgtgagctggtaccagcacttccccggcaccgcccccaagctggtgatcgaggagaacgaccagagacccagcggcatccccgacagattcagcggcagcaagagcggcaccagcgccaccctgggcatcaccggcctgcagaccggcgacgagggcgactactactgcggcacctgggacaccagcctgagcggcggcggcgtgttcggcaccggcaccaaggtgaccgtgctg

SEQ ID NO: 33242 - RNA, 333 nt, synthetic construct
  misc_feature 1..333: note = derived and/or modified sequence opt4 from anti-HIV_048-113988_VR-Chain
  source 1..333: mol_type = other RNA
cagagcgtgctgacccagccccccagcgtgagcgccgcccccggccagatggtgaccatcagctgcagcggcagcagccacaacatcggcgagaactacgtgagctggtaccagcacctgcccggcaccgcccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33243 - RNA, 333 nt, synthetic construct
  misc_feature 1..333: note = derived and/or modified sequence opt4 from anti-HIV_048-112989_VR-Chain
  source 1..333: mol_type = other RNA
cagagcgtgctgacccagccccccagcgccagcggcacccccggccagagagtgaccctgagctgcagcggcggcagcagcaacatcggcaacgacaacgtgtactggtaccagcagagacccggcaccacccccaagctgctgatctacaacgacaacagaagacccagcggcacccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33244 - RNA, 333 nt, synthetic construct
  misc_feature 1..333: note = derived and/or modified sequence opt4 from anti-HIV_048-112435_VR-Chain
  source 1..333: mol_type = other RNA
cagagcgtgctgacccagccccccagcgtgagcgccgcccccggccagaaggtgagcatcagctgcagcggcagcagcagcaacatcggcaagaactacgtgagctggtaccagcagctgcccggcaccgcccccaagctgctgatcttcaagaacaacgagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33245 - RNA, 333 nt, synthetic construct
  misc_feature 1..333: note = derived and/or modified sequence opt4 from anti-HIV_048-111339_VR-Chain
  source 1..333: mol_type = other RNA
cagagcgtgctgacccagccccccagcgtgagcgccgcccccggccagaaggtgaccatcagctgcaccggcagcagcagcaacatcggcggctacgccgtgcactggtaccagcaggtgcccgccaccgcccccaagctgctgatctacgagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33246 - RNA, 333 nt, synthetic construct
  misc_feature 1..333: note = derived and/or modified sequence opt4 from anti-HIV_048-111055_VR-Chain
  source 1..333: mol_type = other RNA
cagagcgccctgacccagcccgccagcgtgagcggcagccccggccagagcatcaccatcagctgcaccggcaccagaagcgacgtgggctacaactacgtgagctggtaccagcagcaccccggcaaggcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33247 - RNA, 333 nt, synthetic construct
  misc_feature 1..333: note = derived and/or modified sequence opt4 from anti-HIV_048-111027_VR-Chain
  source 1..333: mol_type = other RNA
cagagcgtgctgacccagccccccagcgtgagcgccgcccccggccagaaggtgaccatcagctgcagcggcagcaacagcaacctgggcaacaactacgtgagctggtaccagcacctgcccggcaccgcccccagactgctgatctacgaggacaagaagagacccagcggcatccccgacagattcagcggcagcaagagcggcgccagcgccaccctggacatcaccggcctgcagaccggcgacgaggccgactactactgcggcatctgggacaccagcctgagcgccggcggcgtgttcggcaccggcaccaaggtgaccgtgctg

SEQ ID NO: 33248 - RNA, 333 nt, synthetic construct
  misc_feature 1..333: note = derived and/or modified sequence opt4 from anti-HIV_048-109721_VR-Chain
  source 1..333: mol_type = other RNA
cagagcgtgctgacccagccccccagcgtgagcgccgcccccggccagaaggtgaccatcagctgcagcggcagcagcagcgacatcggcagcaacttcgtgagctggtaccagcacctgcccggcaccgcccccagactgctgatctacgagaacaacagaagacccagcggcatccccgacagattcagcggcagcaagagcggcaccagcgccaccctggccatcaccggcctgcagaccggcgacgaggccgactactactgcggcacctgggacaccagcctgaacagaggcggcgtgttcggcaccggcaccaaggtgaccgtgctg

SEQ ID NO: 33249 - RNA, 333 nt, synthetic construct
  misc_feature 1..333: note = derived and/or modified sequence opt4 from anti-HIV_048-109666_VR-Chain
  source 1..333: mol_type = other RNA
cagagcgtgctgacccagccccccagcatgagcgccgcccccggcgagagagtgaccatcagctgcagcggcagcagcagcaacatcggcaaccaccacgtgagctggtaccagcagagacccggcaccgcccccaagctgctgatctacgagaacaacgagagacccagcggcatccccgacagattcagcggcagcaagagcggcagcagcgccaccctggccatcaccggcctgcagaccggcgacgaggccgactactactgcggcacctgggacggcagactgaacatcggcggcgtgatcggcaccggcaccaaggtgaccgtgctg

SEQ ID NO: 33250 - RNA, 333 nt, synthetic construct
  misc_feature 1..333: note = derived and/or modified sequence opt4 from anti-HIV_048-109196_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgagaccaacaagagacccagcggcatccccgacagattcagcggcagcaagagcggcaccagcgccaccctggccatcaccggcctgcagaccggcgacgaggccgactactactgcggcacctgggacaccagcctgagcggcggcggcgtgttcggcaccggcaccaaggtgaccgtgctg

SEQ ID NO: 33251 - RNA, 333 nt, synthetic construct
  misc_feature 1..333: note = derived and/or modified sequence opt4 from anti-HIV_048-109051_VR-Chain
  source 1..333: mol_type = other RNA
cagagcgtgctgacccagccccccagcgtgagcgccgcccccggccagaaggtgaccatcagctgcagcggcaacaacagcaacatggtgaacaactacatcagctggtaccagctgctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33252 - RNA, 333 nt, synthetic construct
  misc_feature 1..333: note = derived and/or modified sequence opt4 from anti-HIV_048-108570_VR-Chain
  source 1..333: mol_type = other RNA
cagagcgccctgacccagccccccagcgtgagcgccgcccccggccagaaggtgaccatcagctgcagcggcaagagcagcaacatcggcaccaacttcgtgagctggtaccagcagttccccgaggccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacggcagcctgagcaccggcggcgtgatcggcaccggcaccaaggtgaccgtgctg

SEQ ID NO: 33253 - RNA, 327 nt, synthetic construct
  misc_feature 1..327: note = derived and/or modified sequence opt4 from anti-HIV_048-108033_VR-Chain
  source 1..327: mol_type = other RNA
gagctgacccagagccccagcgtgagcgccgcccccggccagagagtgaccatcagctgcagcggcaacagcagcaacatcggcaacaactacgtgagctggtaccagctgctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33254 - RNA, 333 nt, synthetic construct
  misc_feature 1..333: note = derived and/or modified sequence opt4 from anti-HIV_048-107279_VR-Chain
  source 1..333: mol_type = other RNA
cagagcgtgctgacccagccccccagcgtgagcgccgcccccggccagaaggtgatcatcagctgcagcggcagcagcagcaacatcggcaagaactacgtgagctggtaccagcacctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacgccagcctgagcgccggcggcgtgctgggcaccggcaccaaggtgaccgtgctg

SEQ ID NO: 33255 - RNA, 333 nt, synthetic construct
  misc_feature 1..333: note = derived and/or modified sequence opt4 from anti-HIV_048-106271_VR-Chain
  source 1..333: mol_type = other RNA
cagagcgtgctgacccagccccccagcgtgagcgccgcccccggccagaaggtgaccatcagctgcagcggcagcagaagcaacatcggcagcaactacatcagctggtaccagcagctgcccggcaccgcccccaagctgctgatctacaagaacgacaagagacccagcggcatccccgacagattcagcggcagcaagagcggcaccagcgccatcctgggcatcaccggcctgcagaccggcgacgaggccgactactactgcggcgcctgggacaccagcctgagcgccggcggcgtgttcggcaccggcaccaaggtgaccgtgctg

SEQ ID NO: 33256 - RNA, 333 nt, synthetic construct
  misc_feature 1..333: note = derived and/or modified sequence opt4 from anti-HIV_048-106054_VR-Chain
  source 1..333: mol_type = other RNA
cagagcgtgctgacccagccccccagcgtgagcgccgcccccggccagcaggtgaccatcagctgcagcggcagcaccagcaacatcggcaacaactacgtgagctggtaccagcaggtgcccggcaccgcccccaagctgctgatctacgacaacaacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33257 - RNA, 333 nt, synthetic construct
  misc_feature 1..333: note = derived and/or modified sequence opt4 from anti-HIV_048-104848_VR-Chain
  source 1..333: mol_type = other RNA
cagagcgccctgacccagcccgccagcgtgagcggcagccccggccagagcatcaccatcagctgcaccggcaccagcagcgacgtgggctacaactacgtgagctggtaccagcagctgcccggcaccgcccccaagctgctgatcttcgacaacgacgacagacccagcgagatccccgacagattcagcggcagcaagagcggcaccagcgccaccctgggcatcaccggcctgcagcccggcgacgaggccgactactactgcggcacctgggacagcagcctgagcgccggcggcgtgttcggcaccggcaccaaggtgaccgtgctg

SEQ ID NO: 33258 - RNA, 333 nt, synthetic construct
  misc_feature 1..333: note = derived and/or modified sequence opt4 from anti-HIV_048-104638_VR-Chain
  source 1..333: mol_type = other RNA
cagagcgtgctgacccagccccccagcgccagcggcacccccggccacagagtgaccatcagctgcagcggcaacagcagcaacatcggcggcaaccacgtgtactggtaccagcaggtgcccggcaccacccccaagctgctgatctacagaaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33259 - RNA, 333 nt, synthetic construct
  misc_feature 1..333: note = derived and/or modified sequence opt4 from anti-HIV_048-104567_VR-Chain
  source 1..333: mol_type = other RNA
cagagcgtgctgacccagccccccagcgccagcggcacccccggccagagagtgaccatcagctgcagcggcagcaacagcaacatcggcaccaacttcgtgaactggtaccagcacgtgcccggcagagcccccaagctgctgatctacaagaacaccgagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33260 - RNA, 333 nt, synthetic construct
  misc_feature 1..333: note = derived and/or modified sequence opt4 from anti-HIV_048-102804_VR-Chain
  source 1..333: mol_type = other RNA
cagagcgtgctgacccagccccccagcgtgagcaccgcccccggccagaaggtgaccatcagctgcagcggcagcagcagcaacatcggctacagctacgtgagctggttccagcacctgcccggcaccgcccccaagctgctgatctacggcaacagcaacagacccagcggcgtgcccgacagattcagcggcagcaagagcggcaccagcgccagcctggccatcaccggcctgcagaccggcgacgaggccgactactactgcggcacctgggacagcagcctgagcgccggcggcgtgttcggcaccggcaccaaggtgaccgtgctg

SEQ ID NO: 33261 - RNA, 333 nt, synthetic construct
  misc_feature 1..333: note = derived and/or modified sequence opt4 from anti-HIV_048-101676_VR-Chain
  source 1..333: mol_type = other RNA
cagagcgtgctgacccagccccccagcgtgagcggcgcccccggccagagcgtgaccatcagctgcaccggcaccagcagcaacatcggcgacttcgacgtgcactggtaccagcagctgcccggcaccgcccccaagctgctgctgtacgagaacaacaagagacccagcggcatccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33262 - RNA, 333 nt, synthetic construct
  misc_feature 1..333: note = derived and/or modified sequence opt4 from anti-HIV_048-097603_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgatctacgacaccgtgaagagacccagcggcatccccgacagattcagcggcagcaagagcggcaccagcgccaccctgggcatcaccggcctgcagaccggcgacgaggccgactactactgcggcacctgggacagcagcctgagcggcggcggcgtgttcggcaccggcaccaaggtgaccgtgctg

SEQ ID NO: 33263 - RNA, 333 nt, synthetic construct
  misc_feature 1..333: note = derived and/or modified sequence opt4 from anti-HIV_048-097107_VR-Chain
  source 1..333: mol_type = other RNA
cagagcgtgctgacccagccccccagcgtgagcgccgcccccggccagaaggtgaccatcagctgcagcggcagcagcagcaacatcgagaacaactacgtgagctggtacagacaggtgcccggcaccgcccccaagctgctgatctacaagaacgacaacagacccagcggcatccccgacagattcagcggcagcaagagcggcaccagcgccaccctgggcatcaccggcctgcagaccggcgacgaggccgactactactgcggcatctgggacaccagcctgagcgccggcggcgtgttcggcaccggcaccaaggtgaccgtgctg

SEQ ID NO: 33264 - RNA, 333 nt, synthetic construct
  misc_feature 1..333: note = derived and/or modified sequence opt4 from anti-HIV_048-096871_VR-Chain
  source 1..333: mol_type = other RNA
cagcccgtgctgacccagccccccagcgccagcggcacccccggccagagagtgaccatcagctgcagcggcagcagcagcaacatcggcagcaactacgtgtactggtaccagcagctgcccggcaccacccccaagctgctgatctacagaaacaaccagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33265 - RNA, 333 nt, synthetic construct
  misc_feature 1..333: note = derived and/or modified sequence opt4 from anti-HIV_048-096668_VR-Chain
  source 1..333: mol_type = other RNA
cagagcgtgctgacccagccccccagcgtgagcgccgcccccggccagaaggtgaccatcagctgcagcggcagcggcagcaacatcggcaacaactacgtgagctggtaccagcagctgcccggcaccgcccccaagctgctgatctacaagaacaccgagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33266 - RNA, 333 nt, synthetic construct
  misc_feature 1..333: note = derived and/or modified sequence opt4 from anti-HIV_048-095236_VR-Chain
  source 1..333: mol_type = other RNA
cagagcgtgctgacccagccccccagcgtgagcgccccccccggccagaaggtgaccatcagctgcagcggcaccaccagcaacatcggcagcaactacgtggcctggtaccagcagctgcccggcaccgcccccaagctggtgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33267 - RNA, 333 nt, synthetic construct
  misc_feature 1..333: note = derived and/or modified sequence opt4 from anti-HIV_048-094155_VR-Chain
  source 1..333: mol_type = other RNA
cagagcgtgctgacccagccccccagcgtgagcgccgcccccggccagaaggtgaccgtgagctgcagcggcagcagcagcgacatcggcgagaactacgtgagctggtaccagcagttccccgagaccgcccccaagctgctgatctacgacaacaacaagagacccagcggcatccccgacagattcagcggcagcaagagcggcaccagcgccaccctggccatcaccggcctgcagaccggcgacgaggccgactactactgcggcacctgggacagcagcctgagcgccggcggcgtgttcggcaccggcaccaaggtgaccgtgctg

SEQ ID NO: 33268 - RNA, 333 nt, synthetic construct
  misc_feature 1..333: note = derived and/or modified sequence opt4 from anti-HIV_048-093219_VR-Chain
  source 1..333: mol_type = other RNA
cagcccctgctgacccagccccccgccgtgagcgccacccccggccagagagtgaccatcagctgcaccggcagcagcagcaacatcggcagaaccttcgtgaactggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33269 - RNA, 333 nt, synthetic construct
  misc_feature 1..333: note = derived and/or modified sequence opt4 from anti-HIV_048-092976_VR-Chain
  source 1..333: mol_type = other RNA
cagagcgtgctgacccagccccccagcgtgagcgccgccagcggccagaaggtgaccatcagctgcagcggcagcagcagcaacatcggcaacaactacgtgagctggtaccagcacctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33270 - RNA, 333 nt, synthetic construct
  misc_feature 1..333: note = derived and/or modified sequence opt4 from anti-HIV_048-090866_VR-Chain
  source 1..333: mol_type = other RNA
cagagcgtgctgacccagccccccagcgtgagcgccgcccccggccagaaggtgaccatcagctgcagcggcagcagaagcaacatcggcagcaactacatcagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggcctactactactgcggcacctgggacaccagcctgagcgccggcggcgtgttcggcagcggcaccaaggtgaccgtgctg

SEQ ID NO: 33271 - RNA, 333 nt, synthetic construct
  misc_feature 1..333: note = derived and/or modified sequence opt4 from anti-HIV_048-090650_VR-Chain
  source 1..333: mol_type = other RNA
cagagcgccctgacccagcccgccagcgtgagcggcagcctgggccagagcatcaccatcagctgcagcggcagcagcagcaccatcggcaacaactacgtgagctggtaccaggtgctgcccggcgccgcccccaagctgctgatctgcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33272 - RNA, 333 nt, synthetic construct
  misc_feature 1..333: note = derived and/or modified sequence opt4 from anti-HIV_048-089009_VR-Chain
  source 1..333: mol_type = other RNA
cagagcgtgctgacccagccccccagcgtgagcgccgcccccggccagaaggtgaccatcagctgcagcggcggcagcagcaacatcggcaacaactacgtgagctggtaccagcagctgcccgagaccgcccccaagctgatcatctacgacaacaacaagagacccagcggcatccacgacagattcagcggcagcaagagcggcaccagcgccaccctggacatcaccgccctgcagaccggcgacgaggccgactactactgcggcacctgggacaccagcctgagcgccggcggcgtgttcggcaccggcaccaaggtgaccgtgctg

SEQ ID NO: 33273 - RNA, 333 nt, synthetic construct
  misc_feature 1..333: note = derived and/or modified sequence opt4 from anti-HIV_048-088654_VR-Chain
  source 1..333: mol_type = other RNA
cagagcgccctgacccagcccagaagcgtgagcgccgcccccggccagaaggtgagcatcagctgcagcggcagaagcaccaacctgggctacaactacgtgagctggtaccagcacctgcccggcgccgcccccaaggtgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33274 - RNA, 333 nt, synthetic construct
  misc_feature 1..333: note = derived and/or modified sequence opt4 from anti-HIV_048-086513_VR-Chain
  source 1..333: mol_type = other RNA
cagagcgccctgacccagccccccagcgtgagcgccgcccccggccagaaggtgaccatcagctgcagcggcagcaccagcaacatcggcaacaactacgtgagctggtaccagcagctgcccggcaccgcccccaagctgctgatctacaagaacgacaacagacccagcggcatccccgacagattcagcagcagcaagagcggcaccagcgccaccctgggcatcaccggcctgcagaccggcgacgaggccgactactactgcggcatctgggacaccagcctgagcgccggcggcgtgttcggcaccggcaccaaggtgaccgtgctg

SEQ ID NO: 33275 - RNA, 324 nt, synthetic construct
  misc_feature 1..324: note = derived and/or modified sequence opt4 from anti-HIV_048-086024_VR-Chain
  source 1..324: mol_type = other RNA
ctggcccagccccccagcgtgagcggcacccccggccagagagtgaccatcagctgcagcggcagcagcagcaacatcggcagcaacgccgtgaactggtaccagcagttccccggcaccgcccccaagctgctgatctacgacaccgacaagagacccagcggcatccccgacagattcagcggcagcaagagcggcaccagcgccatcctgggcatcaccggcctgcagaccggcgacgaggccgactactactgcggcgcctgggacaccagcctgagcgccggcggcgtgttcggcaccggcaccaaggtgaccgtgctg

SEQ ID NO: 33276 - RNA, 333 nt, synthetic construct
  misc_feature 1..333: note = derived and/or modified sequence opt4 from anti-HIV_048-085857_VR-Chain
  source 1..333: mol_type = other RNA
cagagcgccctgacccagcccagaagcgtgagcggcagcctgggccagagcgtgaccatcagctgcaccggcaccaccagcgacgtgggcttcgactacgtgagctggtaccaggtgctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33277 - RNA, 333 nt, synthetic construct
  misc_feature 1..333: note = derived and/or modified sequence opt4 from anti-HIV_048-084277_VR-Chain
  source 1..333: mol_type = other RNA
cagagcgtgctgagacagccccccagcctgagcggcgcccccggccagagagtgaccctgagctgcaccggcagcagcagcaacatcggcggctacgacgtgcactggtaccagcacgtgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33278 - RNA, 333 nt, synthetic construct
  misc_feature 1..333: note = derived and/or modified sequence opt4 from anti-HIV_048-084245_VR-Chain
  source 1..333: mol_type = other RNA
cagagcaccctgacccagccccccagcgtgagcgccgcccccggccagaaggtgaccatcagctgcagcggcagcaacagcaacatcggcaagcactacgtgagctggtaccagcagttccccggcgccgtgcccaagctgctgatctacgagaacaagaagagacccagcggcatccccgacagattcagcggcagcaagagcgacaccagcgccaccctggacatcaccggcctgcagaccggcgacgaggccgactactactgcggcacctgggacaccagcctgagcgccggcggcgtgttcggcagcggcaccaaggtgaccgtgctg

SEQ ID NO: 33279 - RNA, 333 nt, synthetic construct
  misc_feature 1..333: note = derived and/or modified sequence opt4 from anti-HIV_048-082487_VR-Chain
  source 1..333: mol_type = other RNA
cagagcctgctgacccagccccccagcgtgagcgccgcccccggccagaaggtgaccatcagctgcagcggcagcagcagcaccatcggcaacaactacgtgagctggtaccaggtgctgcccggcgccgcccccaagctgctgatctgcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33280 - RNA, 333 nt, synthetic construct
  misc_feature 1..333: note = derived and/or modified sequence opt4 from anti-HIV_048-081787_VR-Chain
  source 1..333: mol_type = other RNA
cagagcgtgctgacccagccccccagcgtgagcggcgcccccggccagagagtgaccatcagctgcaccggcagcagcagcaacatcggcagctacgacgtgcactggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33281 - RNA, 333 nt, synthetic construct
  misc_feature 1..333: note = derived and/or modified sequence opt4 from anti-HIV_048-081062_VR-Chain
  source 1..333: mol_type = other RNA
cagagcgtgctgacccagccccccagcgtgagcgccgcccccggccagaaggtgaccatcagctgcagcggcaccagcagcaacatcggcgccaactacgtgagctggtaccagcaggtgcccggcaccgcccccaagctgctgatctacgagaacaacaagagacccagcggcacccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33282 - RNA, 333 nt, synthetic construct
  misc_feature 1..333: note = derived and/or modified sequence opt4 from anti-HIV_048-079639_VR-Chain
  source 1..333: mol_type = other RNA
cagagcgtgctgacccagccccccagcgtgagcgccgcccccggccagaaggtgaccatcagctgcagcggcagcagcagcaacatcggcaagaactacgtgagctggtaccagcacctgcccggcaccgcccccaagctgctgatctacgagaacaacaagagacccagcggcatccccgacagattcagcggcagcaagagcggcaccgccgccaccctgggcatcaccggcctgcagaccggcgacgaggccggctactactgcggcacctgggacaccagcctgagcgccggcggcgtgttcggcaccggcaccaaggtgaccgtgctg

SEQ ID NO: 33283 - RNA, 333 nt, synthetic construct
  misc_feature 1..333: note = derived and/or modified sequence opt4 from anti-HIV_048-079126_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcacctgcccggcaccccccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33284 - RNA, 333 nt, synthetic construct
  misc_feature 1..333: note = derived and/or modified sequence opt4 from anti-HIV_048-073118_VR-Chain
  source 1..333: mol_type = other RNA
cagagcgtgctgacccagccccccagcgtgagcgccgcccccagacacaacgtgaccatcagctgcagcggcggcagcagcaacatcggcaacaacttcgtgagctggtaccagtacctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33285 - RNA, 333 nt, synthetic construct
  misc_feature 1..333: note = derived and/or modified sequence opt4 from anti-HIV_048-070264_VR-Chain
  source 1..333: mol_type = other RNA
cagagcgtgctgacccagagccccagcgtgagcgccgcccccggccagaaggtgaccatcagctgcagcggcaccagcagcaacatcggcaacacctacgtgagctggtaccagcagctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33286 - RNA, 333 nt, synthetic construct
  misc_feature 1..333: note = derived and/or modified sequence opt4 from anti-HIV_048-069426_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacgtgagctggtaccagcagctgcccggcaccgcccccaagctgctgatctacaagaacaacaagagacccagcggcgtgcccgacagattcagcggcagcaagagcggcaccagcgccacccccggcatcaccggcctgcagaccggcgacgaggccgactactactgcggcacctgggacaccagcctgagcgccggcggcgtgttcggcaccggcaccaaggtgaccgtgctg

SEQ ID NO: 33287 - RNA, 333 nt, synthetic construct
  misc_feature 1..333: note = derived and/or modified sequence opt4 from anti-HIV_048-068564_VR-Chain
  source 1..333: mol_type = other RNA
cagagcgccctgacccagcccagaagcgtgagcggcagccccggccagagcgtggccatcagctgcaccggcaccagcagcgacgtgggctacaactacgtgagctggtaccaggtgctgcccggcaccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33288 - RNA, 333 nt, synthetic construct
  misc_feature 1..333: note = derived and/or modified sequence opt4 from anti-HIV_048-068345_VR-Chain
  source 1..333: mol_type = other RNA
cagagcgtgctgacccagacccccagcgtgagcgccgcccccggccagagagtgaccatcagctgcagcggcagcaccagcaacatcggcaacaactacgtgagctggtaccagcagctgcccggcaccgcccccaagctgctgatctacgagaacaacaagagacccagcggcatcagagacagattcagcgccagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33289 - RNA, 333 nt, synthetic construct
  misc_feature 1..333: note = derived and/or modified sequence opt4 from anti-HIV_048-067337_VR-Chain
  source 1..333: mol_type = other RNA
cagagcgtgctgacccagccccccagcgtgagcgccgcccccggccagaaggtgaccatcagctgcagcggcgccagctacaacatcggcaagaacagcgtgagctggtaccagcagctgcccggcaccgcccccaagctgctgatctacaagaacgacaagagacccagcggcatccccgacagattcagcggcagcaagagcggcgccagcgccaccctggacatcaccggcctgcagaccggcgacgaggccgactactactgcggcatctgggacaccagcctgagcgccggcggcgtgttcggcaccggcaccaaggtgaccgtgctg

SEQ ID NO: 33290 - RNA, 333 nt, synthetic construct
  misc_feature 1..333: note = derived and/or modified sequence opt4 from anti-HIV_048-067180_VR-Chain
  source 1..333: mol_type = other RNA
cagagcgtgctgacccagccccccagcgtgagcgccgcccccggccagaaggtgaccatcagctgcagcggcagcagccccaacatcggcaacaactacgtgagctggtaccagagactgcccggcaccgcccccaagctgctgatctacgagaacgaccagagacccagcggcatccccgacagaatcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33291 - RNA, 333 nt, synthetic construct
  misc_feature 1..333: note = derived and/or modified sequence opt4 from anti-HIV_048-063017_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcaccaccccggcaaggcccccaagctgatgatctacgaggtgagcaagagacccagcggcatccccgacagattcagcggcagcaagagcggcaccagcgccaccctgggcatcaccggcctgcagaccggcgacgaggccgactactactgcggcacctgggacaccagcctgaacagaggcggcgtgttcggcaccggcaccaaggtgaccgtgctg

SEQ ID NO: 33292 - RNA, 333 nt, synthetic construct
  misc_feature 1..333: note = derived and/or modified sequence opt4 from anti-HIV_048-061885_VR-Chain
  source 1..333: mol_type = other RNA
cagagcgtgctgacccagccccccagcgtgagcgccgcccccggccagaaggtgaccatcagctgcagcggcagcagcagcaacatcggcagccactacatcagctggtaccagcagttccccggcgccgcccccaagctgctgatctacgagaacgacaagagacccagcggcatccccgacagattcagcgccagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33293 - RNA, 333 nt, synthetic construct
  misc_feature 1..333: note = derived and/or modified sequence opt4 from anti-HIV_048-061671_VR-Chain
  source 1..333: mol_type = other RNA
cagagcgtgctgacccagccccccagcgccagcggcacccccggccagagagtgaccatcagctgcagcggcagcagaagcaacatcggcagcaactacgtgtactggtaccagcagttccccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33294 - RNA, 333 nt, synthetic construct
  misc_feature 1..333: note = derived and/or modified sequence opt4 from anti-HIV_048-060700_VR-Chain
  source 1..333: mol_type = other RNA
cagagcgtgctgacccagctgcccagcctgagcgccgcccccggccagaaggtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgagtactactgcgccacctgggacgccagcctgagcggcggcggcgtgttcggcaccggcaccaaggtgaccgtgctg

SEQ ID NO: 33295 - RNA, 333 nt, synthetic construct
  misc_feature 1..333: note = derived and/or modified sequence opt4 from anti-HIV_048-060592_VR-Chain
  source 1..333: mol_type = other RNA
cagagcgtgctgacccagccccccagcgtgagcgccgcccccggccagaaggtgaccatcagctgcagcggcagcagcagcaacatcggcaagaactacgtgagctggtaccagcagttccccggcaccgcccccaagctgctgatctacgagaacaacaagagacccagcggcatccccgacagattcagcgccagcaagagcgccaccagcgccaccctggtgatcaccggcctgcagaccggcgacgaggccgtgtactactgcggcacctgggacaccagcctgagcgccggcggcgtgttcggcagcggcaccaaggtgaccgtgctg

SEQ ID NO: 33296 - RNA, 333 nt, synthetic construct
  misc_feature 1..333: note = derived and/or modified sequence opt4 from anti-HIV_048-060300_VR-Chain
  source 1..333: mol_type = other RNA
cagcccgtgctgacccagccccccagcgccagcggcacccccggccagagagtgaccatcagctgcagcggcagcagcagcaacatcggcaccaacaccgtgaactggtaccagcagttccccggcaccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33297 - RNA, 333 nt, synthetic construct
  misc_feature 1..333: note = derived and/or modified sequence opt4 from anti-HIV_048-059141_VR-Chain
  source 1..333: mol_type = other RNA
cagcccgtgctgacccagccccccagcgccagcggcacccccggccagagagtgagcatcagctgcagcggcaacttcagcaacatcggcagcaagtacgtgtactggtaccagcagatccccggcaccgcccccaacgtgatcatctacagaaccaacctgagacccagcggcatccccgacagattcagcgccagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33298 - RNA, 333 nt, synthetic construct
  misc_feature 1..333: note = derived and/or modified sequence opt4 from anti-HIV_048-057777_VR-Chain
  source 1..333: mol_type = other RNA
cagagcgtgctgacccagccccccagcctgagcgccgcccccggccagagagtgaccatcagctgcagcggcagcagcagcaacatcggcaacaactacgtgagctggtaccagcagttccccggcaccgcccccaccctgctgatctacgagaacgacaagagacccagcggcatccccgacagattcagcgccagcaagagcggcaccagcgccaccctgggcatcaccggcctgcaggccggcgacgaggccgactactactgcggcacctgggacaccagcctgagcgccggcggcgtgttcggcaccggcaccaaggtgaccgtgctg

SEQ ID NO: 33299 - RNA, 333 nt, synthetic construct
  misc_feature 1..333: note = derived and/or modified sequence opt4 from anti-HIV_048-056928_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacgtgagctggtaccagctgctgcccggcaccgcccccaagctgctgatctacgacaacgacaacagacccagcgacatccccgacagattcagcggcagcaagagcggcaccagcgccaccctgggcatcaccggcctgcagaccggcgacgaggccgactactactgcggcgcctgggacaccagcctgagcgccggcggcgtgttcggcaccggcaccaaggtgaccgtgctg

SEQ ID NO: 33300 - RNA, 333 nt, synthetic construct
  misc_feature 1..333: note = derived and/or modified sequence opt4 from anti-HIV_048-056131_VR-Chain
  source 1..333: mol_type = other RNA
cagttcgtgctgacccagcccgccagcgtgagcggcagccccggccagagcatcaccatcagctgcagcggcaccagcagcgacgtgggctacaactacgtgagctggtaccagcagctgcccggcaccgcccccaagctgctgatctacgagaacaccaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33301 - RNA, 333 nt, synthetic construct
  misc_feature 1..333: note = derived and/or modified sequence opt4 from anti-HIV_048-055864_VR-Chain
  source 1..333: mol_type = other RNA
cagagcgtgctgacccagccccccagcgtgagcgtggcccccggccagaaggtgaccatctactgcagcggcagcagcagcaacatcggcaagaacagcgtgagctggtacgtgcaggtgcccggcaccgcccccaagttcctgatctacgagaacaaccagagacccagcggcatcagcgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33302 - RNA, 333 nt, synthetic construct
  misc_feature 1..333: note = derived and/or modified sequence opt4 from anti-HIV_048-055094_VR-Chain
  source 1..333: mol_type = other RNA
cagagcgtgctgacccagccccccagcgtgagcggcgcccccggccagagagtgaccatcagctgcagcgccagcagcagcagcatcggcaacgacttcgtgagctggtaccagcagctgcccggcaccgcccccaagctgctgatcagcgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33303 - RNA, 333 nt, synthetic construct
  misc_feature 1..333: note = derived and/or modified sequence opt4 from anti-HIV_048-054343_VR-Chain
  source 1..333: mol_type = other RNA
cagagcgtgctgacccagccccccagcgtgagcggcgcccccggccagagagtgaccatcagctgcaccggcagcagcagcaacatcggcggctacgacgtgaactggtaccagcagctgcccggcaccgcccccaagctgctgatcttcaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33304 - RNA, 333 nt, synthetic construct
  misc_feature 1..333: note = derived and/or modified sequence opt4 from anti-HIV_048-054193_VR-Chain
  source 1..333: mol_type = other RNA
cagagcgtgctgacccagccccccagcgtgagcgccgcccccggccagaaggtgaccatcagctgcagcggcggcagcagcaacatcggcaacaactacgtgagctggtaccaccaggtgcccggcaccgcccccaagctgctgatcttcgagaacaacaagagacccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33305 - RNA, 333 nt, synthetic construct
  misc_feature 1..333: note = derived and/or modified sequence opt4 from anti-HIV_048-052521_VR-Chain
  source 1..333: mol_type = other RNA
cagagcgtgctgacccagccccccagcgtgagcgccgcccccggccagaaggtgaccatcagctgcagcggcagcagcagcaacatcggcagacacagcgtgagctggtaccagcagctgcccggcaccgcccccaagctgctgatctacgacaccgacaagagacccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33306 - RNA, 333 nt, synthetic construct
  misc_feature 1..333: note = derived and/or modified sequence opt4 from anti-HIV_048-049037_VR-Chain
  source 1..333: mol_type = other RNA
cagagcgtgctgacccagccccccagcgtgagcgccgcccccggccagaaggtgaccatcagctgcagcggcagcagcttcaacatcggcaacaactacgtgagctggtaccagcacctgcccggcaccgcccccaagctgctgatctacgccgccgtgaccagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33307 - RNA, 333 nt, synthetic construct
  misc_feature 1..333: note = derived and/or modified sequence opt4 from anti-HIV_048-048720_VR-Chain
  source 1..333: mol_type = other RNA
cagagcgtgctgacccagccccccgccgtgagcgccgcccccggccagagagtggccatcagctgcagcggcaccagcagcaacatcggcagcaacctggtgagctggtaccagcagctgcccggcaaggcccccagactgctgatctacgacaactacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33308 - RNA, 333 nt, synthetic construct
  misc_feature 1..333: note = derived and/or modified sequence opt4 from anti-HIV_048-048542_VR-Chain
  source 1..333: mol_type = other RNA
cagagcgtgctgacccagccccccagcgtgagcgccgcccccggccagaaggtgaccatcagctgcagcggcagcagcagcaacatcggcaacaacttcgtgagctggtaccagcagctgcccggcaccgcccccaagctgctgatctacaacaacgacagaagacccagcggcgtgcccgacagattcagcgccagcaagttcggcaccgccgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33309 - RNA, 333 nt, synthetic construct
  misc_feature 1..333: note = derived and/or modified sequence opt4 from anti-HIV_048-047777_VR-Chain
  source 1..333: mol_type = other RNA
cagagcgtgctgacccagccccccagcgccagcggcacccccggccagagagtgaccatcagctgcagcggcagcagcgccaacatcggcaccaactacgtgttctggtaccagcacctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33310 - RNA, 333 nt, synthetic construct
  misc_feature 1..333: note = derived and/or modified sequence opt4 from anti-HIV_048-046841_VR-Chain
  source 1..333: mol_type = other RNA
cagagcgtgctgacccagccccccagcgtgagcgccgccctgggccagaaggtgaccatcacctgcagcggcgacaacggcaacatcggctaccactacgtgagctggtaccagcaggtgggcagagccgcccccaagctgctgatctacgccaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33311 - RNA, 333 nt, synthetic construct
  misc_feature 1..333: note = derived and/or modified sequence opt4 from anti-HIV_048-046202_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcacctgcccggcaccgcccccaagctgctgatctacgacacctacaagagacacagcggcgtgcccgacagattcagcaacagcaagagcggcaccagcgccaccctggccatcaccggcctgcagaccggcgacgagggcgactactactgcggcgcctgggacaccagcctgagcgccggcggcgtgttcggcaccggcaccaaggtgaccgtgctg

SEQ ID NO: 33312 - RNA, 333 nt, synthetic construct
  misc_feature 1..333: note = derived and/or modified sequence opt4 from anti-HIV_048-046059_VR-Chain
  source 1..333: mol_type = other RNA
cagagcgtgctgacccagccccccagcgtgagcgccgcccccggccagaacgtgaccatcagctgcagcggcaccagcagcaacatcgagaacaactacgtgagctggtaccagaccctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33313 - RNA, 333 nt, synthetic construct
  misc_feature 1..333: note = derived and/or modified sequence opt4 from anti-HIV_048-043568_VR-Chain
  source 1..333: mol_type = other RNA
cagagcgtgctgacccagccccccagcgtgagcgccgcccccggccagaaggtgaccatcagctgcagcggcagcgacagcaacatcggcagcaactacgtgagctggtaccagcagctgcccggcgccgcccccaagctgctgatctacaagaacaacaacagacccagcggcatccccgacagattcagcggcagcaagagcggcaccagcgccaccctgggcatcagcggcctgcagaccggcgacgaggccgactactactgcggcacctgggacaccagcctgagcggcggcggcgtgttcggcaccggcaccaaggtgaccgtgctg

SEQ ID NO: 33314 - RNA, 333 nt, synthetic construct
  misc_feature 1..333: note = derived and/or modified sequence opt4 from anti-HIV_048-042713_VR-Chain
  source 1..333: mol_type = other RNA
cagagcgtgctgacccagccccccagcgtgagcgccgcccccggccagaaggtgaccatcagctgcagcggcagcagcagcaacatcggcagacactacgtgagctggtaccagcagctgcccggcaccgcccccaagctgctgatctacgacaacaacagcagacccagcggcatccccgacagattcagcggcagcaagagcggcaccagcgccaccctgggcatcaccggcctgcagaccggcgacgaggccgactactactgcggcacctgggacaccagcctgaacagaggcggcgtgttcggcaccggcaccaaggtgaccgtgctg

SEQ ID NO: 33315 - RNA, 333 nt, synthetic construct
  misc_feature 1..333: note = derived and/or modified sequence opt4 from anti-HIV_048-042440_VR-Chain
  source 1..333: mol_type = other RNA
cagagcgtgctgacccagccccccagcgccagcggcacccccggccagagagtgaccatcagctgcagcggcagcagcagcaacatcggcaccaacaccgtgaactggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33316 - RNA, 333 nt, synthetic construct
  misc_feature 1..333: note = derived and/or modified sequence opt4 from anti-HIV_048-040511_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcacctgcccggcaccgcccccaagctgctgatctacgagaacaacaagagaagcagcggcatccccgagagattcagcggcagccagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33317 - RNA, 333 nt, synthetic construct
  misc_feature 1..333: note = derived and/or modified sequence opt4 from anti-HIV_048-039195_VR-Chain
  source 1..333: mol_type = other RNA
cagagcgtgctgacccagccccccagcgtgagcgccgcccccggccagagagtgaccatcagctgcagcggcagcaccagcaacatcggcaaccactacgtgagctggtaccagcagctgcccggcaccgcccccaagctgctgatctacgacaacggcaacagacccagcggcatccccgacagattcagcggcagcaagagcggcaccagcgccaccctggacatcaccggcctgcagaccggcgacgaggccgactactactgcggcacctgggacaccagcctgaacagaggcggcgtgttcggcaccggcaccaaggtgaccgtgctg

SEQ ID NO: 33318 - RNA, 333 nt, synthetic construct
  misc_feature 1..333: note = derived and/or modified sequence opt4 from anti-HIV_048-036935_VR-Chain
  source 1..333: mol_type = other RNA
cagagcgtgctgacccagccccccagcatgagcgccgcccccggcgagagagtgaccatcagctgcaccggcagcagcagcaacatcggcggctacgacgtgcactggtaccagcagctgcccggcatcgcccccaagatcctgatctacagaaacagcatcagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33319 - RNA, 333 nt, synthetic construct
  misc_feature 1..333: note = derived and/or modified sequence opt4 from anti-HIV_048-034478_VR-Chain
  source 1..333: mol_type = other RNA
cagagcgtgctgacccagccccccagcgtgagcgccgcccccggccagaaggtgaccatcagctgcaccggcagcggcagcaacatcggcaacaacgacgtgagctggtaccagcagctgcccggcaccgcccccagactgctgatctacggcgacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33320 - RNA, 333 nt, synthetic construct
  misc_feature 1..333: note = derived and/or modified sequence opt4 from anti-HIV_048-031641_VR-Chain
  source 1..333: mol_type = other RNA
cagagcgtgctgacccagccccccagcgtgagcgccgcccccggccagaaggtgaccatcagctgcagcggcaacaacagcaacatcggcaacaactacgtgagctggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33321 - RNA, 333 nt, synthetic construct
  misc_feature 1..333: note = derived and/or modified sequence opt4 from anti-HIV_048-029760_VR-Chain
  source 1..333: mol_type = other RNA
cagagcgccctgacccagcccgccagcgtgagcggcagcagcggccagagcatcaccatcagctgcaccggcaccaacagcgacgtgggctacgactacgtgtgctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33322 - RNA, 333 nt, synthetic construct
  misc_feature 1..333: note = derived and/or modified sequence opt4 from anti-HIV_048-027970_VR-Chain
  source 1..333: mol_type = other RNA
cagagcgtgctgacccagccccccagcgtgagcgccccccccggccagaaggtgaccatcagctgcagcggcaccaccagcaacatcggcagcaactacgtggcctggtaccagcagttccccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcgccacctgggacaccagcctgagcgccggcggcgtgttcggcaccggcaccaaggtgaccgtgctg

SEQ ID NO: 33323 - RNA, 333 nt, synthetic construct
  misc_feature 1..333: note = derived and/or modified sequence opt4 from anti-HIV_048-027337_VR-Chain
  source 1..333: mol_type = other RNA
cagagcgtgctgacccagccccccagcgtgagcgccgcccccggccagaaggtgaccatcagctgcagcggcagctacagcaacatcggcaacaactacctgagctggtaccagcagctgcccggcaccgcccccaagctgctgatctacaagaacaacaagagacccagcggcgtgcccgacagattcagcggcagcaagagcggcgccagcgccaccctggacatcaccggcctgcagaccggcgacgaggccgactactactgcggcatctgggacaccagcctgagcgccggcggcgtgttcggcaccggcaccaaggtgaccgtgctg

SEQ ID NO: 33324 - RNA, 333 nt, synthetic construct
  misc_feature 1..333: note = derived and/or modified sequence opt4 from anti-HIV_048-027217_VR-Chain
  source 1..333: mol_type = other RNA
cagagcgtgctgacccagccccccagcgtgagcgccgcccccggccagaaggtgaccatcagctgcagcggcagcagcagcatcatcggcaacaactacgtgagctggtaccagcagctgcccggcaccgcccccaagctgctgatctacgagaacaacaagagacccagcggcatccccgacagattcagcggcagcaagagcggcaccagcgccaccctggccatcgccggcctgcagaccggcgacgaggccgactactactgcgccacctgggacaccagcctgagcgccggcggcgtgttcggcaccggcaccaaggtgaccgtgctg

SEQ ID NO: 33325 - RNA, 333 nt, synthetic construct
  misc_feature 1..333: note = derived and/or modified sequence opt4 from anti-HIV_048-026760_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcacctgcccggcaccgcccccaagctgctgatctacgacaccgtgaagagacacagcggcgtgcccgacagattcagcggcagcaagagcggcaccagcgccaccctgggcatcagcggcctgcagaccggcgacgaggccgactactactgcggcacctgggacaccagcctgagcgccggcggcgtgttcggcagcggcaccaaggtgaccgtgctg

SEQ ID NO: 33326 - RNA, 333 nt, synthetic construct
  misc_feature 1..333: note = derived and/or modified sequence opt4 from anti-HIV_048-024800_VR-Chain
  source 1..333: mol_type = other RNA
cagagcgtgctgacccagccccccagcgtgagcgccgcccccggccagaaggtgaccatcagctgcagcggcagctacagcaacatcggcaacaactacgtgagctggtaccaggtgctgcccggcaccgcccccaagctgctgatctacaagaacaacgagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33327 - RNA, 333 nt, synthetic construct
  misc_feature 1..333: note = derived and/or modified sequence opt4 from anti-HIV_048-024313_VR-Chain
  source 1..333: mol_type = other RNA
cagagcgtgctgacccagccccccagcgtgagcgccgcccccggccagaaggtgaccatcagctgcagcggcagcagcagcaccatcggcaacagccacgtgagctggtaccagatcctgcccggcaccgcccccaagctgctgatctacaaggacgacaagagacccagcggcatccccgacagattcagcggcagcaagagcggcaccagcgccaccctgggcatcaccggcctgcagaccggcgacgaggccgactactactgcggcacctgggacaccagcctgaacagaggcggcgtgttcggcaccggcaccaaggtgaccgtgctg

SEQ ID NO: 33328 - RNA, 333 nt, synthetic construct
  misc_feature 1..333: note = derived and/or modified sequence opt4 from anti-HIV_048-021748_VR-Chain
  source 1..333: mol_type = other RNA
cagagcgtgctgacccagccccccagcgtgagcgccgcccccggccagagagtgaccatcagctgcagcggcagcaccagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcagcggcctgcagaccggcgacgaggccgactactactgcggcacctgggacagcagcctgagcggcggcggcgtgttcggcaccggcaccaaggtgaccgtgctg

SEQ ID NO: 33329 - RNA, 333 nt, synthetic construct
  misc_feature 1..333: note = derived and/or modified sequence opt4 from anti-HIV_048-020991_VR-Chain
  source 1..333: mol_type = other RNA
cagagcgtgctgacccagccccccagcgccagcggcacccccggccagaaggtgaccatcagctgcagcggcagcagcagcaccatcggcaacaactacgtgagctggtaccaggtgctgcccggcaccgcccccaagctgctgatctacaagaacgacaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33330 - RNA, 333 nt, synthetic construct
  misc_feature 1..333: note = derived and/or modified sequence opt4 from anti-HIV_048-020340_VR-Chain
  source 1..333: mol_type = other RNA
cagagcgtgctgacccagccccccagcgtgagcgccgcccccggccagagagtgaccatcagctgcagcggcagcagcagcaacgtgggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacgccagcctgagcgccggcggcgtgttcggcaccggcaccaaggtgaccgtgctg

SEQ ID NO: 33331 - RNA, 333 nt, synthetic construct
  misc_feature 1..333: note = derived and/or modified sequence opt4 from anti-HIV_048-019993_VR-Chain
  source 1..333: mol_type = other RNA
cagagcgtgctgacccagccccccagcgtgagcggcgcccccggccagagagtgaccatcagctgcaccggcagcagcagcagcatcggcggcttcgacgtgcactggtaccagagactgcccggcaccgcccccagactgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33332 - RNA, 333 nt, synthetic construct
  misc_feature 1..333: note = derived and/or modified sequence opt4 from anti-HIV_048-019947_VR-Chain
  source 1..333: mol_type = other RNA
cagagcgtgctgacccagccccccagcgtgagcgccgcccccggccagagagtgaccatcagctgcagcggcagcagcagcaacatcggcagcaagtacgtgagctggtaccagcagctgcccggcaccgcccccaagctgctgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcaccggcggcgtgttcggcaccggcaccaaggtgaccgtgctg

SEQ ID NO: 33333 - RNA, 333 nt, synthetic construct
  misc_feature 1..333: note = derived and/or modified sequence opt4 from anti-HIV_048-017871_VR-Chain
  source 1..333: mol_type = other RNA
cagagcgtgctgacccagccccccagcgtgagcgccgcccccggccagaaggtgaccatcagctgcagcggcagcagcagcaacatcggcaacagatacgtgagctggtaccagcagctgcccggcaccgcccccaagctgctgatctacaagaacaacaagagacccagcggcatccccgacagattcagcggcagcaagagcggcaccagcgccaccctgggcatcaccggcctgcagaccggcgacgaggccgactactactgcggcacctgggacggcagcctgagcaccggcggcgtgatcggcaccggcaccaaggtgaccgtgctg

SEQ ID NO: 33334 - RNA, 333 nt, synthetic construct
  misc_feature 1..333: note = derived and/or modified sequence opt4 from anti-HIV_048-015931_VR-Chain
  source 1..333: mol_type = other RNA
cagagcgtgctgacccagccccccagcgtgagcgccgcccccggccagaaggtgaccatcagctgcagcggcggcagcagcaacatcggcagcacctacgtgagctggtaccagcaggtgcccggcaccgcccccaagctgctgatctacgagaacaacaagagacccagcggcatccccgacagattcagcggcagcaagagcggcaccagcgccaccctggacatcaccggcctgcagaccggcgacgaggccgactactactgcggcacctgggacaccagcctgagcggcggcggcgtgttcggcaccggcaccaaggtgaccgtgctg

SEQ ID NO: 33335 - RNA, 333 nt, synthetic construct
  misc_feature 1..333: note = derived and/or modified sequence opt4 from anti-HIV_048-015920_VR-Chain
  source 1..333: mol_type = other RNA
cagagcctgctgacccagccccccagcgtgagcgccgcccccggccagaaggtgaccatcagctgcagcggcagcagcagcaccatcggcaacaactacgtgagctggtaccaggtgctgcccggcaccgcccccaagctgctgatctacaagaacaacgagagacccagcggcatccccgacagattcagcggcagcaagagcggcaccagcgccaccctgggcatcaccggcctgcagaccggcgacgaggccgagtactactgcgccacctgggacgccagcctgagcggcggcggcgtgttcggcaccggcaccaaggtgaccgtgctg

SEQ ID NO: 33336 - RNA, 333 nt, synthetic construct
  misc_feature 1..333: note = derived and/or modified sequence opt4 from anti-HIV_048-013898_VR-Chain
  source 1..333: mol_type = other RNA
cagagcgtgctgacccagccccccagcgtgagcgccgcccccggccagaaggtgaccatcagctgcagcggcagcagcagcaacatcggcaagcacagcgtgagctggtaccagcagctgcccggcaccgcccccgagctgctgatctacgacaacaacaacagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33337 - RNA, 333 nt, synthetic construct
  misc_feature 1..333: note = derived and/or modified sequence opt4 from anti-HIV_048-013429_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaccctgctgatctacgagaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33338 - RNA, 333 nt, synthetic construct
  misc_feature 1..333: note = derived and/or modified sequence opt4 from anti-HIV_048-012358_VR-Chain
  source 1..333: mol_type = other RNA
cagagcgtgctgacccagccccccagcgtgagcgccgcccccggccagaaggtgaccatcagctgcagcggcagcaacagcgccatcggcaacaactacgtgagctggtaccaggtgctgcccggcaccgcccccaagctgctgatctacaagaacaacgagagacccagcggcatccccgacagattcagcggcagcaagagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33339 - RNA, 333 nt, synthetic construct
  misc_feature 1..333: note = derived and/or modified sequence opt4 from anti-HIV_048-011158_VR-Chain
  source 1..333: mol_type = other RNA
cagagcgtgctgacccagccccccagcgtgagcgccgcccccggccagaaggtgaccatcagctgcagcggcatcagcagcaacatcggcaacaacgacgtgagctggtaccagcagctgcccggcaccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33340 - RNA, 333 nt, synthetic construct
  misc_feature 1..333: note = derived and/or modified sequence opt4 from anti-HIV_048-010720_VR-Chain
  source 1..333: mol_type = other RNA
cagagcgtgctgacccagccccccagcgtgagcgccgcccccggccagaaggtgaccatcagctgcagcggcagcagcagcaacatcggcagccactacgtgagctggtaccagcaggtgcccggcaccgcccccagactggtgatctacgagaacagcaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcagcggcaccaaggtgaccgtgctg

SEQ ID NO: 33341 - RNA, 333 nt, synthetic construct
  misc_feature 1..333: note = derived and/or modified sequence opt4 from anti-HIV_048-009445_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgtgcccaagctgctgatctacgacacctacaccagacccagcggcacccccgacagattcagcggcagcaagagcggcaccagcgccaccctggccatcaccggcctgcagaccggcgacgaggccgactactactgcggcacctgggacggcagcctgagcaccggcggcgtgatcggcaccggcaccaaggtgaccgtgctg

SEQ ID NO: 33342 - RNA, 324 nt, synthetic construct
  misc_feature 1..324: note = derived and/or modified sequence opt4 from anti-HIV_048-006126_VR-Chain
  source 1..324: mol_type = other RNA
cagagcgtgctgacccagccccccagcgtgagcggcgcccccggccagaaggtgaccatcagctgcagcggcatcagcagcaacttcggcatcagctggtaccagcaggtgcccggcaccgcccccaagctgctgatctacgagaacgacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33343 - RNA, 333 nt, synthetic construct
  misc_feature 1..333: note = derived and/or modified sequence opt4 from anti-HIV_048-005652_VR-Chain
  source 1..333: mol_type = other RNA
cagagcgtgctgacccagccccccagcgtgagcgccgcccccggccagaaggtgaccatcagctgcagcggcagcaacagcgccatcggcaacaactacgtgagctggtaccaggtgctgcccggcaccgcccccaagctgctgatctacgacacctacaagagagccagcggcatccccgacagattcagcggcagcaagagcggcaccagcgccaccctgggcatcaccggcctgcagaccggcgacgaggccgactactactgcggcacctgggacaccagcctgagcggcggcggcgtgttcggcaccggcaccaaggtgaccgtgctg

SEQ ID NO: 33344 - RNA, 333 nt, synthetic construct
  misc_feature 1..333: note = derived and/or modified sequence opt4 from anti-HIV_048-005532_VR-Chain
  source 1..333: mol_type = other RNA
cagagcgtgctgacccagccccccagcgtgagcgccgcccccggccagaaggtgaccatcagctgcagcggcaccagcagcaacatcggcaacacctacgtgagctggtaccagcagctgcccggcaccgcccccaactacctgatctacaagatcgacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33345 - RNA, 333 nt, synthetic construct
  misc_feature 1..333: note = derived and/or modified sequence opt4 from anti-HIV_048-005189_VR-Chain
  source 1..333: mol_type = other RNA
cagagcgtgctgacccagccccccagcgtgagcgccgcccccggccagaaggtgaccatcagctgcagcggcagcggcagcaccatcggcaacaacgacgtgagctggtaccagcagctgcccggcgccgcccccaagctgctgatctacgaggacaacaagagacccagcggcatccccgccagattcagcggcagcaagagcggcaccagcgccaccctgagaatcaccggcctgcagaccggcgacgaggccgactactactgcggcacctgggacagcagcctgagcgccggcggcgtgttcggcaccggcaccagagtgagcgtgctg

SEQ ID NO: 33346 - RNA, 333 nt, synthetic construct
  misc_feature 1..333: note = derived and/or modified sequence opt4 from anti-HIV_048-005088_VR-Chain
  source 1..333: mol_type = other RNA
cagagcgtgctgacccagccccccagcgtgagcgccgcccccggccagaaggtgaccatcagctgcagcggcagcagcagcaacatcggcaagaactacgtgagctggtaccagcagctgcccggcaccgcccccaagctgctgatctacgacaacaacaacagacccagcggcatccccgacagattcagcggcagcaagagcggcaccagcgccaccctgggcatcaccggcctgcagaccggcgacgaggccgactactactgcggcgcctgggacaccagcctgagcgccggcggcgtgttcggcaccggcaccaaggtgaccgtgctg

SEQ ID NO: 33347 - RNA, 333 nt, synthetic construct
  misc_feature 1..333: note = derived and/or modified sequence opt4 from anti-HIV_048-004023_VR-Chain
  source 1..333: mol_type = other RNA
cagagcgtgctgacccagccccccagcgtgagcgccacccccggccagaaggtgaccatcagctgcagcggcggcagcagcaacatcggcaagaacgacgtgagctggtaccagcagctgcccggcaccgcccccaagctgctgatctacgacaccaacaagagacccagcggcatccccgacagattcagcgccgccagaagcggcaccagcgccaccctggacatcaccggcctgcagaccggcgacgaggccgactactactgcggcacctgggacaccagcctgagcgccggcggcgtgttcggcaccggcaccaaggtgaccgtgctg

SEQ ID NO: 33348 - RNA, 333 nt, synthetic construct
  misc_feature 1..333: note = derived and/or modified sequence opt4 from anti-HIV_048-001580_VR-Chain
  source 1..333: mol_type = other RNA
cagagcgtgctgacccagccccccagcgtgagcgccgcccccggccagaaggtgaccatcagctgcagcggcagcagcagcaacatcggcaacaactacgtgagctggtaccagcagctgcccggcaccgcccccaagctgctgctgtacgagaacaacaagagacccagcggcatccccgacagattcagcggcagcaagagcggcaccagcgccaccctggccatcaccggcctgcagaccggcgacgaggccgcctactactgcggcacctgggacggcagcctgagcaccggcggcgtgatcggcaccggcaccaaggtgaccgtgctg

SEQ ID NO: 33349 - RNA, 333 nt, synthetic construct
  misc_feature 1..333: note = derived and/or modified sequence opt4 from anti-HIV_038-221120_VR-Chain
  source 1..333: mol_type = other RNA
cagagcgtgctgacccagccccccagcgtgagcgccgcccccggccagaaggtgaccatcagctgcagcggcagcaccagcaacatcggcaagaactacgtgagctggtaccagcagctgcccggcaccgcccccaagctgctgatctacgacaacaacgagagacccagcggcatccccgacagattcagcggcagcaagagcggcaccagcgccaccctgggcatcaccggcctgcagaccggcgacgaggccgactactactgcgccacctgggacagcagcctgagcggcggcggcgtgttcggcaccggcaccagagtgaccgtgctg

SEQ ID NO: 33350 - RNA, 333 nt, synthetic construct
  misc_feature 1..333: note = derived and/or modified sequence opt4 from anti-HIV_038-197677_VR-Chain
  source 1..333: mol_type = other RNA
cagagcgtgctgacccagccccccagcgtgagcgccgcccccggccagaaggtgaccgtgagctgcagcggcagcaacagcaacatcggcaaccactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33351 - RNA, 333 nt, synthetic construct
  misc_feature 1..333: note = derived and/or modified sequence opt4 from anti-HIV_038-196765_VR-Chain
  source 1..333: mol_type = other RNA
cagagcgccctgacccagcccgccagcgtgagcggcagccccggccagagcatcaccatcagctgcaccggcaccagcggcgacgtgggctacaacctggtgagctggtaccagcagctgcccggcaccgcccccaaggtgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33352 - RNA, 333 nt, synthetic construct
  misc_feature 1..333: note = derived and/or modified sequence opt4 from anti-HIV_038-186200_VR-Chain
  source 1..333: mol_type = other RNA
cagagcgtgctgacccagccccccagcgccagcggcacccccggccagagaatcaccatcagctgcagcggcaccagcagcaacatcggcagcaacatcgtgagctggtaccagcacctgcccggcaccacccccaagctggtgatcttcagaaacaaccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33353 - RNA, 333 nt, synthetic construct
  misc_feature 1..333: note = derived and/or modified sequence opt4 from anti-HIV_038-126170_VR-Chain
  source 1..333: mol_type = other RNA
cagagcgtgctgacccagccccccagcgtgagcgccccccccggccagaaggtgaccatcagctgcagcggcaccaccagcaacatcggcagcaactacgtggcctggtaccagcagctgcccggcaccgcccccaagctgctgatctacgacaacgtgaagagacccaccaacatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33354 - RNA, 333 nt, synthetic construct
  misc_feature 1..333: note = derived and/or modified sequence opt4 from anti-HIV_038-108545_VR-Chain
  source 1..333: mol_type = other RNA
cagagcgtgctgacccagccccccagcgccagcggcacccccggccagagagtgaccatcagctgcagcggcagcagcagcaacatcggctacaacaccgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33355 - RNA, 333 nt, synthetic construct
  misc_feature 1..333: note = derived and/or modified sequence opt4 from anti-HIV_038-107263_VR-Chain
  source 1..333: mol_type = other RNA
cagagcgtgctgacccagccccccagcgccagcggcacccccggccagagagtgaccatcagctgcagcggcagcagcagcaacatcggcagcaacaccgtgaactggtaccagcaggtgcccggcaccgcccccaacctgctgatctacagcaacgaccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33356 - RNA, 333 nt, synthetic construct
  misc_feature 1..333: note = derived and/or modified sequence opt4 from anti-HIV_038-104530_VR-Chain
  source 1..333: mol_type = other RNA
cagagcgtgctgacccagccccccagcgtgagcgccgcccccggccagaaggtgaccatcagctgcagcggcagcagcagcaacatcggcagcaactacgtgagctggtaccagcacctgcccggcaaggcccccaagctgctgatctacgacaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33357 - RNA, 333 nt, synthetic construct
  misc_feature 1..333: note = derived and/or modified sequence opt4 from anti-HIV_038-099169_VR-Chain
  source 1..333: mol_type = other RNA
cagagcgtgctgacccagccccccagcgccagcggcacccccggccagagagtgagcatcagctgcagcggcatcaccagcagcctgggcagcaaccacatgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33358 - RNA, 333 nt, synthetic construct
  misc_feature 1..333: note = derived and/or modified sequence opt4 from anti-HIV_038-075067_VR-Chain
  source 1..333: mol_type = other RNA
cagagcgtgctgacccagccccccagcgtgagcggcgcccccggccagagagtgaccatcagctgcagcggcagcagcagcaccatcggcaacaactacgtgagctggtaccagctgctgcccggcaccgcccccaagctgctgatctacaagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33359 - RNA, 333 nt, synthetic construct
  misc_feature 1..333: note = derived and/or modified sequence opt4 from anti-HIV_038-072368_VR-Chain
  source 1..333: mol_type = other RNA
cagagcgtgctgacccagagccccagcgccagcggcacccccggccagagagtgaccatcagctgcagcggcagcagcagcaacatcggcaacaactacgtgagctggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33360 - RNA, 333 nt, synthetic construct
  misc_feature 1..333: note = derived and/or modified sequence opt4 from anti-HIV_038-068503_VR-Chain
  source 1..333: mol_type = other RNA
cagagcgtgctgacccagccccccagcgtgagcgccgcccccggccagatggtgaccatcagctgcagcggcagcagaagcaacatcgagaaccactacgtgagctggtaccagcacctgcccggcgccgcccccaagctgctgatctacgacaacggcaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33361 - RNA, 333 nt, synthetic construct
  misc_feature 1..333: note = derived and/or modified sequence opt4 from anti-HIV_038-068016_VR-Chain
  source 1..333: mol_type = other RNA
cagagcgtgctgacccagccccccagcgccagcggcacccccggccagagagtgaccatcagctgcagcggcagcagcagcaacatcgagagcaacttcgtgtactggtaccagcagttccccggcaccacccccaagctgctgatctacagagacggccagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33362 - RNA, 333 nt, synthetic construct
  misc_feature 1..333: note = derived and/or modified sequence opt4 from anti-HIV_038-063958_VR-Chain
  source 1..333: mol_type = other RNA
cagagcgtgctgacccagccccccagcgtgagcggcgcccccggccagagagtgaccatcagctgcaccggcagcagcagcaacatcggcaacagcggcgtgcactggtaccagcagctgcccggcaccgcccccaagctgctgatctacgagaacaacaagagacccagcggcatccccgacagattcagcggcagcaagagcggcaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33363 - RNA, 333 nt, synthetic construct
  misc_feature 1..333: note = derived and/or modified sequence opt4 from anti-HIV_038-033733_VR-Chain
  source 1..333: mol_type = other RNA
cagagcgtgctgacccagccccccagcgccagcggcacccccggccagagagtgaccatcagctgcagcggcagcagcagcaacatcggcagcaagtacgtgtactggtaccagcagctgcccggcaccgcccccaagctgctgatctacgacaacgacaagagacccagcggcatccccgacagaatcagcgccagcaagagcggcaccagcgccaccctggacatcaccagactgcagaccggcgacgaggccgactactactgcggcacctgggacagcagcctgagcgccggcggcgtgttcggcaccggcaccaaggtgaccgtgctg

SEQ ID NO: 33364 - RNA, 333 nt, synthetic construct
  misc_feature 1..333: note = derived and/or modified sequence opt4 from anti-HIV_038-030557_VR-Chain
  source 1..333: mol_type = other RNA
cagagcgtgctgacccagccccccagcgtgagcgccgcccccggccagaaggtgaccatcagctgcagcggcagcagcagcaccatcggcaacaactacgtgagctggtaccagctgctgcccggcaccgcccccaagctgctgatctacaagaacaacaagagacccagcggcatccccgacagattcagcggcagcaagagcggcaccagcgccaccctgggcatcaccggcctgcagaccggcgacggcgccgactactactgcggcacctgggacaccagcctgagcgccggcggcgtgttcggcaccggcaccatcgtgaccgtgctg

SEQ ID NO: 33365 - RNA, 333 nt, synthetic construct
  misc_feature 1..333: note = derived and/or modified sequence opt4 from anti-HIV_038-024298_VR-Chain
  source 1..333: mol_type = other RNA
cagagcgtgctgacccagccccccagcgtgagcgccgcccccggccagaaggtgaccatcagctgcagcggcagcagcagcaacatcggcaacagccacgtgagctggtaccagcagttccccggcaccggccccaagctgctgatctacgagaacgccaagagacccagcggcatccccgacagaatcagcggcagcaagagcgacaccagcgccaccctgggcatcaccggcctgcagaccggcgacgaggccgactactactgcggcacctgggacagcagcctgagcgccggcggcgtgttcggcaccggcaccaaggtgaccgtgctg

SEQ ID NO: 33366 - RNA, 333 nt, synthetic construct
  misc_feature 1..333: note = derived and/or modified sequence opt4 from anti-HIV_038-011154_VR-Chain
  source 1..333: mol_type = other RNA
cagagcgtgctgacccagccccccagcgtgagcgccgcccccggccagagaatcaccatcagctgcagcggcagcagcagcaacatcggcaacaactacgtgagctggtaccagcagctgcccggcaccgcccccaagctgctgatctacaagaacaacaagagacccagcggcatccccgacagattcagcggcagcaagagcggcaccagcgccaccctgggcatcaccggcctgcagaccggcgacgaggccgactactactgcggcacctgggacaccagcctgagcgccggcggcgtgttcggcaccggcaccaaggtgaccgtgctg

SEQ ID NO: 33367 - RNA, 318 nt, synthetic construct
  misc_feature 1..318: note = derived and/or modified sequence opt4 from anti-HIV-1_LightChain
  source 1..318: mol_type = other RNA
gagatcgtgctgacccagagccccggcaccctgagcctgagccccggcgagagagccaccctgagctgcagagccagccagagcgtgagcaacaacttcctggcctggtaccagtacaagcccggccagccccccagagtgctgatctacggcaccagcagaagagccagcggcatccccgacagattcagcggcagcggcagcggcaccgacggcagcctgaccatcagcagactggaggccgaggacttcgccgtgtactactgccagcagtacgagttcttcggccagggcaccagactggagatgaagagaacc

SEQ ID NO: 33368 - RNA, 318 nt, synthetic construct
  misc_feature 1..318: note = derived and/or modified sequence opt4 from anti-HIV-1_LightChain
  source 1..318: mol_type = other RNA
gaggtggtgctgacccagagccccggcaccctgagcctgagccccggcgagagagccaccctgagctgcagagccagccagagcgtgagcagaaactacctggcctggtaccagcagaagctgggccacggccccagactgctggtgtacgccaccagcagaagagccaccggcatccccgacagattcatcggcagccagagcggcaccgagtacaacctgaccatcaccagactggaccccggcgacttcgcccagtacttctgccagcagtacgagttcttcggccccggcaccagactggacatcaagagaacc

SEQ ID NO: 33369 - RNA, 309 nt, synthetic construct
  misc_feature 1..309: note = derived and/or modified sequence opt4 from anti-HIV-1_LightChain
  source 1..309: mol_type = other RNA
gaggtggtgctgacccagagccccggcaccctgagcctgagccccggcgagagagccagcttcagctgcaagagcagccagtacggccacaccgcctggtaccagcagaagctgggccacggccccagactgctgatctacgccaccagcagaagagccaccggcatccccgacagattcatcggcagccagagcggcaccgagtacaacctgaccatcaccagactggaccccggcgacttcgcccactacttctgccagcagaacgagttcttcggccccggcaccagactggacatgaagagaacc

SEQ ID NO: 33370 - RNA, 306 nt, synthetic construct
  misc_feature 1..306: note = derived and/or modified sequence opt4 from anti-HIV-1_LightChain
  source 1..306: mol_type = other RNA
gagatcgtgctgacccagagccccagcagcctgagcctgagccccggcgagagagccagcctgagctgcagaggcagccacggccacgtggcctggtaccagcacaagcccggccagatccccagactgctgatctacgccaccagcaagagagccagcggcatcagcgacagattcagcggcagcggcagcggcaccgacgccaccctgagcatcagcagactggagcccgaggacttcgccgtgtacttctgccagcagtacgagttcttcggccagggcaccagactggagatcaagagaacc

SEQ ID NO: 33371 - RNA, 306 nt, synthetic construct
  misc_feature 1..306: note = derived and/or modified sequence opt4 from anti-HIV-1_LightChain
  source 1..306: mol_type = other RNA
gagatcatgctgacccagagccccggcaccctgagcctgagccccggcgagagagccaccctgagctgcagaggcagccacggccacgtggcctggtaccagcagaagcccggcagaatccccagactgctgatctacggcaccagcaagagagccagcggcatccccgacagattcagcggcagcggcagcggcaccgacgccaccctgaccatcagcagactggagagcgaggacttcgccgtgtacttctgccagcagtacgagttcttcggccagggcaccagactggacatcaacagaacc

SEQ ID NO: 33372 - RNA, 309 nt, synthetic construct
  misc_feature 1..309: note = derived and/or modified sequence opt4 from anti-HIV-1_LightChain
  source 1..309: mol_type = other RNA
gagagcgtgctgacccagagccccggcaccctgagcctgagccccggcgagaccgccagcctgagctgcaccgccgccctgtacggccacatgacctggtaccagaagaagcccggccagccccccaagctgctgctgtacgccagcagcaagagagccagcggcatccccgacagattcagcggcagccagttcggcaagcagtacaccctgatcatcaccaagatggagcccgaggacttcgccgagtactactgccagcagttcgaggtgttcggccagggcaccagactggacatgagaagaacc

SEQ ID NO: 33373 - RNA, 306 nt, synthetic construct
  misc_feature 1..306: note = derived and/or modified sequence opt4 from anti-HIV-1_LightChain
  source 1..306: mol_type = other RNA
gaggtggtgctgacccagagccccggcaccctgagcctgagccccggcgagagagccaccctgagctgcagaggcagccacggccacctgagctggtaccagtacaagcccggccagccccccagagtgctgatctacggcaccagcagaagagccagcggcatccccgacagattcagcggcagcggcagcggcaccgacggcagcctgaccatcagcagactggaggccgaggacttcgccgtgtactactgccagcagtacgagttcttcggccagggcaccagactggagatgaagagaacc

SEQ ID NO: 33374 - RNA, 309 nt, synthetic construct
  misc_feature 1..309: note = derived and/or modified sequence opt4 from anti-HIV-1_LightChain
  source 1..309: mol_type = other RNA
gaggtggtgctgacccagagccccggcaccctgagcctgagccccggcgagagagccagcctgagctgcaagagcagccagtacggccacaccgcctggtaccagcagaagctgggccagggccccagactgctgatctacgccaccagcagaagagccaccggcatccccgacagattcagcggcagccagagcggcaccgagtacaacctgaccatcaccagactggaccccggcgacttcgcccagtacttctgccagcagtacgagttcttcggccccggcaccagactggacatcaagagaacc

SEQ ID NO: 33375 - RNA, 306 nt, synthetic construct
  misc_feature 1..306: note = derived and/or modified sequence opt4 from anti-HIV-1_LightChain
  source 1..306: mol_type = other RNA
gagatcatgctgacccagagccccggcaccctgagcctgagccccggcgagagagccaccctgagctgcagaggcagccacggccacgtggcctggtaccagcagaagcccggcagaatccccagactgctgatctacggcaccagcaagagagccagcggcatccccgacagattcagcggcagcggcagcggcaccgacgccaccctgaccatcagcagactggagagcgaggacttcgccgtgtactactgccagcagtacgagttcttcggccagggcaccagactggacatcaagagaacc

SEQ ID NO: 33376 - RNA, 309 nt, synthetic construct
  misc_feature 1..309: note = derived and/or modified sequence opt4 from anti-HIV-1_LightChain
  source 1..309: mol_type = other RNA
gagagcgtgctgacccagagccccggcaccctgagcctgagccccggcgagaccgccagcctgagctgcaccgccgccagctacggccacatgacctggtaccagaagaagcccggccagccccccaagctgctgatcttcgccaccagcaagagagccagcggcatccccgacagattcagcggcagccagttcggcaagcagtacaccctgaccatcaccagaatggagcccgaggacttcgccggctactactgccagcaggtggagttcttcggccagggcaccagactggagatcagaagaacc

SEQ ID NO: 33377 - RNA, 309 nt, synthetic construct
  misc_feature 1..309: note = derived and/or modified sequence opt4 from anti-HIV-1_LightChain
  source 1..309: mol_type = other RNA
gacatccagatgacccagagccccagcagcctgagcgccagcgtgggcgacagagtgaccatcacctgccaggccagccaggacatcagcaactacctgaactggtaccagcagaagcccggcaaggcccccaagctgctgatctacgacgccagcaacctggagaccggcgtgcccagcagattcagcggcagcggcttccacaccaccttcagcctgaccatcagcggcctgcagagagacgacttcgccacctacttctgcgccgtgctggagttcttcggccccggcaccaaggtggacttcaac

SEQ ID NO: 33378 - RNA, 309 nt, synthetic construct
  misc_feature 1..309: note = derived and/or modified sequence opt4 from anti-HIV-1_LightChain
  source 1..309: mol_type = other RNA
gacatccagatgacccagagccccagcagcctgagcgccagcgtgggcgacagagtgaccatcacctgccaggccagccaggacatcaccaactacctgaactggtaccagcagaagcccggcagagcccccaagctgctggtgcacggcgccagcaacctgcagagaggcgtgcccagcagattcagcggcagcggcttccacaccaccttcaccctgaccatcagcagcctgcagcccgacgacgtggccacctacttctgcgaggtgttccagtggttcggccccggcaccagagtggacttcaac

SEQ ID NO: 33379 - RNA, 309 nt, synthetic construct
  misc_feature 1..309: note = derived and/or modified sequence opt4 from anti-HIV-1_LightChain
  source 1..309: mol_type = other RNA
ggcttccagctgacccagagccccagcagcctgagcgccagcgtgggcgacagagtgagcatcaactgccaggccggcgagggcatcggcagcagcctgaactggtaccagcagaagcccggcagagcccccaagctgctggtgcacggcgccagcaacctgcagagaggcgtgcccagcagattcagcggcagcggcttccacaccaccttcaccctgaccatcagcagcctgcagcccgacgacgtggccacctacttctgcgaggtgttccagtggttcggccccggcaccagagtggacttcaac

SEQ ID NO: 33380 - RNA, 309 nt, synthetic construct
  misc_feature 1..309: note = derived and/or modified sequence opt4 from anti-HIV-1_LightChain
  source 1..309: mol_type = other RNA
ggcatccagctgacccagagccccagcagcctgagcgtgagcgtgggcgacagagtgaccatcacctgcagagccagccagggcatcggcaacagcctgaactggtaccagcagaagcccggcaaggcccccaacctgatggtgttcggcaccaccaagctgaacagaggcgtgcccagcagattcagcggcagcggcagcggcaccaccgccaccctgaccatcaacagcctgcagcccgaggacatcgccacctacttctgccaggtgttcgagttcctgggccccggcaccaagctggacatgaag

SEQ ID NO: 33381 - RNA, 309 nt, synthetic construct
  misc_feature 1..309: note = derived and/or modified sequence opt4 from anti-HIV-1_LightChain
  source 1..309: mol_type = other RNA
gacatccagatgacccagagccccagcagcctgagcgccagcgtgggcgacagagtgaccatcacctgccaggccggccagggcatcggcagcagcctgaagtggtaccagcagaagcccggcagagcccccagactgctggtgcacggcgccagcaacctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggacttcaac

SEQ ID NO: 33382 - RNA, 309 nt, synthetic construct
  misc_feature 1..309: note = derived and/or modified sequence opt4 from anti-HIV-1_LightChain
  source 1..309: mol_type = other RNA
ggcatccagctgacccagagccccagcagcctgagcgccagcgtgggcgacagagtgaccatcacctgccaggccagccagggcatcggcagcagcctgcagtggtaccagcagaagcccggcagagcccccaacctgctggtgcacggcgccagcaacctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggagatcaag

SEQ ID NO: 33383 - RNA, 309 nt, synthetic construct
  misc_feature 1..309: note = derived and/or modified sequence opt4 from anti-HIV-1_LightChain
  source 1..309: mol_type = other RNA
ggcgtgcagctgacccagagccccagcagcctgagcgccagcgtgggcgacagagtgagcatcaactgccaggccggccagggcatcggcagcagcctgaactggtaccagcagaagagaggcaaggcccccaagctgctggtgcacggcgccagcaccctgcagagaggcgtgcccagcagattcagcggcagcggcttccacaccaccttcaccctgaccatcagcagcctgcagcccgacgacgtggccacctacttctgcgaggtgttccagtggttcggccccggcaccagagtggacttcaac

SEQ ID NO: 33384 - RNA, 306 nt, synthetic construct
  misc_feature 1..306: note = derived and/or modified sequence opt4 from anti-HIV-1_LightChain
  source 1..306: mol_type = other RNA
tacatccagctgacccagagccccagcagcctgagcgccagcatcggcgacagagtgaccatcgcctgcagagccagccagggcatcggctacgtgcactggtaccagcagaagagaggcaagccccccaagctgctgatccacggcgccagcatcctggagagaggcgtgcccagcagattcagcggcagcggcagcggcaccctgttcaacctgaccgtgagcggcctgcagcccgaggacttcgccacctacatgtgccaggtgttcgagagcttcggccccggcaccaaggtgcagatgaag

SEQ ID NO: 33385 - RNA, 309 nt, synthetic construct
  misc_feature 1..309: note = derived and/or modified sequence opt4 from anti-HIV-1_LightChain
  source 1..309: mol_type = other RNA
ggcatccagctgacccagagccccagcagcctgagcgccagcctgggcgacagagtgaccatcacctgccaggccagccagggcatcggcagcagcctgcagtggtaccagcagaagcccggcaaggcccccaagctgctggtgcacggcgccagcaagctgcacagaggcgtgcccagcagattcagcggcagcggcttccacaccaccttcagcctgaccatcagcagcctgcagcccgaggacttcgccacctacctgtgccaggtgctggagttcttcggccccggcaccaaggtggacttcaac

SEQ ID NO: 33386 - RNA, 309 nt, synthetic construct
  misc_feature 1..309: note = derived and/or modified sequence opt4 from anti-HIV-1_LightChain
  source 1..309: mol_type = other RNA
ggcatccagctgacccagagccccagcagcctgagcgccagcgtgggcgacaccgtgaccatcacctgccaggccagccagggcatcggcagcagcctgcagtggtaccagcagaagagaggcagagcccccaagctgctggtgcacggcgccagcaacctgcagggcggcgtgcccagcagattcagcggcagcggcttccacaccaccttcaccctggccatcagaggcctgcagcccgacgacttcgccacctacttctgccagagcctggagttcttcggccccggcaccaaggtggacatgaag

SEQ ID NO: 33387 - RNA, 306 nt, synthetic construct
  misc_feature 1..306: note = derived and/or modified sequence opt4 from anti-HIV-1_LightChain
  source 1..306: mol_type = other RNA
tacatccagctgacccagagccccagcagcctgagcgccagcgtgggcgacagagtgaccatcacctgcagagccagccaggacatcggctacgtgagctggtacgcccagaagagaggcagagcccccaagctgctgatccacggcgccagcggcctggagagaggcgtgcccagcagattcagcggcagcggcagcggcaccctgttcaccctgaccatcgagagcctgcagcccgaggacttcgccacctacatgtgccaggtgttcgagagcttcggccccggcaccaaggtggagatgaag

SEQ ID NO: 33388 - RNA, 309 nt, synthetic construct
  misc_feature 1..309: note = derived and/or modified sequence opt4 from anti-HIV-1_LightChain
  source 1..309: mol_type = other RNA
ggcatccagctgacccagagccccagcagcctgagcgccagcgtgggcgacagagtgagcatcaactgccaggccggccagggcatcggcagcagcctgaactggtaccagcagaagcccggcagagcccccaagctgctggtgcacggcgccagcaacctgcagagaggcgtgcccagcagattcagcggcagcggcttccacaccaccttcaccctgaccatcagcagcctgcagcccgacgacgtggccacctacttctgcgccgtgttccagtggttcggccccggcaccagagtggacttcaac

SEQ ID NO: 33389 - RNA, 366 nt, synthetic construct
  misc_feature 1..366: note = derived and/or modified sequence opt4 from anti-HIV-1_HeavyChain
  source 1..366: mol_type = other RNA
agccagcagctggtgcagagcggcacccaggtgaagaagcccggcgccagcgtgagaatcagctgccaggccagcggctacaccttcaccgactacgtgctgcactggtggagacaggcccccggccagggcctggagtggatgggctggatcaagcccgtgtacggcgccagaaactacgccagaagattccagggcagaatcgacttcagcagagacatctacagagagatcgcctacatggacctgagcggcctgagaagcgacgacaccgccctgtacttctgcgccagagacggcagcggcgacgacaccagctggcacctggacccctggggccagggcaccctggtgatcgtgagcgcc

SEQ ID NO: 33390 - RNA, 366 nt, synthetic construct
  misc_feature 1..366: note = derived and/or modified sequence opt4 from anti-HIV-1_HeavyChain
  source 1..366: mol_type = other RNA
agccagcagctggtgcagagcggcacccaggtgaagaagcccggcgccagcgtgagaatcagctgccaggccagcggctacaccttcaccgactacctgctgcactggtggagacaggcccccggccagagactggagtggatgggctggatcaagcccgtgtacggcgccagaaactacgcccacagattccagggcagaatcaacttcgacagagacatctacagagagatcgccttcatggacctgagcggcctgagaagcgacgacaccgccgtgtacttctgcgccagagacggcggcggcgacgacagaacctggctgctggacacctggggccagggcaccctggtggtggtgagcagc

SEQ ID NO: 33391 - RNA, 366 nt, synthetic construct
  misc_feature 1..366: note = derived and/or modified sequence opt4 from anti-HIV-1_HeavyChain
  source 1..366: mol_type = other RNA
caggtgcacctggagcagcccggcagcgtggtgagatggcccggcgccagcctgaccctgagctgcaccgccagcggctacatcttcgtgaactaccacatccactggctgagacaggcccccggccagagactggagctgctgggcaccatcaaccccgtgggcggcgccaccagctacgcccagaagttcagaggcagactggtgctgaccagagacatcggcagcagcaccgtgaccctgctgctgaaccacctgagaagagacgacagcgccgtgtacttctgcgccagagagagcaacgccagcggcagaggcagaagcatggaccactggggcagaggcagcagagtgatcgtgagccag

SEQ ID NO: 33392 - RNA, 366 nt, synthetic construct
  misc_feature 1..366: note = derived and/or modified sequence opt4 from anti-HIV-1_HeavyChain
  source 1..366: mol_type = other RNA
caggtgcagctggtgcagagcggcgccgaggtgaagaagcccggcgccagcgtgagagtgagctgccaggccagcggctacaccttcaccaactacatcctgcactggtggagacaggcccccggccagggcctggagtggatgggcctgatcaagcccgtgtacggcgccgtgaactacgccagacagttccagggcagaatccagctgaccagagacatctacagagagatcgccttcctggacctgagcggcctgagaagcgacgacaccgccgtgtactactgcgccagagacgagagcggcgacgacctgaagtggcacctgcacccctggggccagggcacccaggtgatcgtgagcccc

SEQ ID NO: 33393 - RNA, 366 nt, synthetic construct
  misc_feature 1..366: note = derived and/or modified sequence opt4 from anti-HIV-1_HeavyChain
  source 1..366: mol_type = other RNA
caggtgcagctggtgcagagcggcgccgaggtgaagaagcccggcgccagcgtgagaatcagctgccaggccagcggctacaccttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgcctacatggacctgagcggcctgagaagcgacgacaccgccagatacttctgcgccagagacggcagcggcgacgacaccagctggcacctgcacccctggggccagggcaccctggtgatcgtgagcgcc

SEQ ID NO: 33394 - RNA, 366 nt, synthetic construct
  misc_feature 1..366: note = derived and/or modified sequence opt4 from anti-HIV-1_HeavyChain
  source 1..366: mol_type = other RNA
agccagcagctggtgcagagcggcacccaggtgaagaagcccggcgccagcgtgagagtgagctgccaggccagcggctacaccttcaccaactacatcctgcactggtggagacaggcccccggccagggcctggagtggatgggcctgatcaagcccgtgtacggcgccgtgaactacgccagacagttccagggcagaatccagctgaccagagacatctacagagagatcgccttcctggacctgagcggcctgagaaccgacgacaccgccgtgtactactgcgccagagacgagagcggcgacgacctgaagtggcacctgcacccctggggccagggcacccaggtgatcgtgagcccc

SEQ ID NO: 33395 - RNA, 366 nt, synthetic construct
  misc_feature 1..366: note = derived and/or modified sequence opt4 from anti-HIV-1_HeavyChain
  source 1..366: mol_type = other RNA
caggtgcacctggagcagagcggcagcgtggtgagatggcccggcgccagcctgaccctgagctgcaccgccagcggctacatcttcgtgaactaccacatccactggctgagacaggcccccggccagagactggagctgatgggcaccatcaaccccgtgggcggcgccaccagctacacccagagattcagaggcagactggtgctgaccagagacatcggcagcaacaccgtgaccctgctgctgaaccacctgagaagcgacgacagcgccgtgtacttctgcgccagagagagcaacgccagcggcagaggcagaagcatggaccactggggcagaggcagccacgtgatcgtgagcccc

SEQ ID NO: 33396 - RNA, 366 nt, synthetic construct
  misc_feature 1..366: note = derived and/or modified sequence opt4 from anti-HIV-1_HeavyChain
  source 1..366: mol_type = other RNA
agccagcacctggtgcagagcggcacccaggtgaagaagcccggcgccagcgtgagagtgagctgccaggccagcggctacaccttcaccaactacatcctgcactggtggagacaggcccccggccagggcctggagtggatgggcctgatcaagcccgtgtacggcgccgtgaactacgccagacagttccagggcagaatccagctgaccagagacatctacagagacatcgccttcctggacctgagcggcctgagaagcgacgacaccgccgtgtactactgcgccagagacgagagcggcgacgacctgaagtggcacctgcacccctggggccagggcacccaggtgatcgtgagcccc

SEQ ID NO: 33397 - RNA, 366 nt, synthetic construct
  misc_feature 1..366: note = derived and/or modified sequence opt4 from anti-HIV-1_HeavyChain
  source 1..366: mol_type = other RNA
agccagcagctggtgcagagcggcacccaggtgaagaagcccggcgccagcgtgagaatcagctgccaggccagcggctacaccttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgcctacatggacctgagcggcctgagaagcgacgacaccgccagatacttctgcgccagagacggcagcggcgacgacaccagctggcacctgcacccctggggccagggcaccctggtgatcgtgagcgcc

SEQ ID NO: 33398 - RNA, 366 nt, synthetic construct
  misc_feature 1..366: note = derived and/or modified sequence opt4 from anti-HIV-1_HeavyChain
  source 1..366: mol_type = other RNA
caggtgcacctggagcagcccggcagcgtggtgagatggcccggcgccagcctgaccctgagctgcaccgccagcggctacatcttcgtgaactaccacatccactggctgagacaggcccccggccagagactggagctgctgggcaccatcaaccccgtgggcggcgccaccagctacgcccagaagttcagaggcagactggtgctgaccagagacatcggcagcagcaccgtgaccctgctgctgaaccacctgagaagagacgacagcgccgtgtacttctgcgccagagagagcaacgccagcggcagaggcagaagcatggaccactggggcagaggcaagcccgtgatcgtgagcccc

SEQ ID NO: 33399 - RNA, 321 nt, synthetic construct
  misc_feature 1..321: note = derived and/or modified sequence opt4 from anti-HIV-1_HeavyChain
  source 1..321: mol_type = other RNA
gagatcgtgatgacccagagccccgccatcctgagcgtgagccccggcgacagagccaccttcagctgcagagccagccagagcgtgaagaacaacctggcctggtaccagaagagacccggccaggcccccagactgctgatcttcgacgccagcagcagagccagcggcatccccgccagattcagcggcggcggcagcggcaccgagttcaccctgaccgtgaacagcatgcagagcgaggacttcgccacctactactgccagcagtacgaggagtggcccagaaccttcggccagggcaccaaggtggagatcatg

SEQ ID NO: 33400 - RNA, 321 nt, synthetic construct
  misc_feature 1..321: note = derived and/or modified sequence opt4 from anti-HIV-1_HeavyChain
  source 1..321: mol_type = other RNA
cagatcgtgctgacccagagcccccccaccctgagcctgagccccggcgagagagccaccctgagctgcagagccagccagagcgtgaagaacaacctggcctggtaccagaagagacccggccaggcccccagactgctgatcttcgacaccagcagcagagccagcaacatccccgccagattcagcggcggcggcagcggcaccgagttcaccctgaccgtgaacagcatgcagagcgaggacttcgccacctactactgccagcagtacgaggagtggcccagaaccttcggccagggcaccaaggtggagatcatc

SEQ ID NO: 33401 - RNA, 321 nt, synthetic construct
  misc_feature 1..321: note = derived and/or modified sequence opt4 from anti-HIV-1_HeavyChain
  source 1..321: mol_type = other RNA
gagatcgtgatgacccagagccccgccgtgctgagcgtgagccccggcgacagagccaccctgagctgcagagccagccagagcgtgaagaacaacctggcctggtaccagaagagacccggccaggcccccagactgctgatcttcgacaccagcagcagagccagcaacatccccgccagattcagcggcggcggcagcggcaccgagttcaccctgaccgtgaacagcatgcagagcgaggacttcgccacctactactgccagcagtacgaggagtggcccagaaccttcggccagggcaccaaggtggagatcaac

SEQ ID NO: 33402 - RNA, 321 nt, synthetic construct
  misc_feature 1..321: note = derived and/or modified sequence opt4 from anti-HIV-1_HeavyChain
  source 1..321: mol_type = other RNA
gagatcgtgctgacccagagcccccccaccctgagcgtgagccccggcgaggccgccaccctgagctgcagagccagccagagcgtgaagaacaacctggcctggtaccacctgaaggccggccaggcccccagactgctgatcttcgacgccagcagcagagccggcgacgcccccgccagagtgagcggcagcggctacggcaccgagttcaccctgaccgtgaacagcgtgcagagcgaggacttcggcgactactactgccagcagtacgaggagtggcccagaaccttcggccagggcaccaaggtggacctgaga

SEQ ID NO: 33403 - RNA, 321 nt, synthetic construct
  misc_feature 1..321: note = derived and/or modified sequence opt4 from anti-HIV-1_HeavyChain
  source 1..321: mol_type = other RNA
gagatcgtgatgacccagagcccccccaccctgagcgtgagccccggcgagaccgccaccctgagctgcagagccagccagaacgtgaagaacaacctggcctggtaccagctgaagcccggccaggcccccagactgctgatcttcgacgccagcagcagagccggcggcatccccgacagattcagcggcagcggctacggcaccgacttcaccctgaccgtgaacagcgtgcagagcgaggacttcggcgactacttctgccagcagtacgaggagtggcccagaaccttcggccagggcaccaaggtggacctgaga

SEQ ID NO: 33404 - RNA, 321 nt, synthetic construct
  misc_feature 1..321: note = derived and/or modified sequence opt4 from anti-HIV-1_HeavyChain
  source 1..321: mol_type = other RNA
gagatcgtgatgacccagagccccgccgtgctgagcgtgagccccggcgacagagccaccctgagctgcagagccagccagagcgtgaagaacaacctggcctggtaccagaagagacccggccaggcccccagactgctgatcttcgacaccagcagcagagccagcaacatccccgccagattcagcggcggcggcagcggcaccgagttcaccctgaccgtgaacagcatgcagagcgaggacttcgccacctactactgccagcagtacgaggagtggcccagaaccttcggccagggcaccaaggtggagatcatc

SEQ ID NO: 33405 - RNA, 399 nt, synthetic construct
  misc_feature 1..399: note = derived and/or modified sequence opt4 from anti-HIV-1_HeavyChain
  source 1..399: mol_type = other RNA
gaggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcagaaaccagttcttcctgagactgaccagcatgaccgccgacgacaccgccgtgtactactgcgtgaagcacaagtaccacgacatcgtgatggtggtgcccatcgccggctggttcgacccctggggccagggcctgcaggtgaccgtgagcgcc

SEQ ID NO: 33406 - RNA, 399 nt, synthetic construct
  misc_feature 1..399: note = derived and/or modified sequence opt4 from anti-HIV-1_HeavyChain
  source 1..399: mol_type = other RNA
gaggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcagaaaccagttcttcctgagactgaccagcatgaccgccgacgacaccgccgtgtactactgcgtgaagcacaagtaccacgacatcgtgatggtggtgcccatcgccggctggttcaacccctggggccagggcctgcaggccaccgtgcccagc

SEQ ID NO: 33407 - RNA, 399 nt, synthetic construct
  misc_feature 1..399: note = derived and/or modified sequence opt4 from anti-HIV-1_HeavyChain
  source 1..399: mol_type = other RNA
caggtgcagctgaaggagagcggccccggcctggtgaagcccagcgagaccctgagcctgacctgcaccgtgagcggcggcagcatgagaggcaccgactggggcgagaacgacttccactacggctggatcagacacagcagcgccgagggcctggagtggatcggcagcatccactggagaggcaccacccactacaagatgagcttcagaagcagagccaccatcagcatcgacaccagcaacaacagattcagcctgatgttcagcttcgtgaccgccgaggacaccgccgtgtactactgcgccagacacaagtaccacgacatcttcagagtggtgcccgtggccggctggttcgacccctggggccagggcctgctggtgaccgtgagcagc

SEQ ID NO: 33408 - RNA, 399 nt, synthetic construct
  misc_feature 1..399: note = derived and/or modified sequence opt4 from anti-HIV-1_HeavyChain
  source 1..399: mol_type = other RNA
gaggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcaagaaccagttcagcctgagactgaccagcatgaccgccgacgacaccgccgtgtactactgcgtgaagcacaagtaccacgacatcgtgatggtggtgcccttcgccggctggttcgacccctggggccagggcctgagagtgaccgtgagcgcc

SEQ ID NO: 33409 - RNA, 399 nt, synthetic construct
  misc_feature 1..399: note = derived and/or modified sequence opt4 from anti-HIV-1_HeavyChain
  source 1..399: mol_type = other RNA
gaggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcaagaaccagttcttcctgagactgaccagcatgaccgccgacgacaccgccgtgtactactgcgtgaagcacaagtaccacgacatctgcatggtggtgcccatcgccggctggttcgacccctggggccagggcctgcaggtgaccgtgagccag

SEQ ID NO: 33410 - RNA, 399 nt, synthetic construct
  misc_feature 1..399: note = derived and/or modified sequence opt4 from anti-HIV-1_HeavyChain
  source 1..399: mol_type = other RNA
caggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcagaaaccagttcttcctgagactgaccagcatgaccgccgacgacaccgccgtgtactactgcgtgaagcacaagtaccacgacatcgtgatggtggtgcccatcgccggctggttcgacccctggggccagggcctgcaggtgaccgtgagcagc

SEQ ID NO: 33411 - RNA, 399 nt, synthetic construct
  misc_feature 1..399: note = derived and/or modified sequence opt4 from anti-HIV-1_HeavyChain
  source 1..399: mol_type = other RNA
caggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcagaaaccagttcttcctgagactgaccagcatgaccgccgacgacaccgccgtgtactactgcgtgaagcacaagtaccacgacatcgtgatggtggtgcccatcgccggctggttcgacccctggggccagggcctgagagtgaccgtgagccag

SEQ ID NO: 33412 - RNA, 399 nt, synthetic construct
  misc_feature 1..399: note = derived and/or modified sequence opt4 from anti-HIV-1_HeavyChain
  source 1..399: mol_type = other RNA
caggtgcacctgcaggagagcggccccggcctggtgagacccctggagaccctgagcctgacctgcaccgccagcggcgccagcatcagaggcggcgagtggggcgacaacgactaccactggggctgggtgagacacagccccggcaagggcctggagtggatcggcagcatccactggagaggcaccacccactacaacgcccccttcagaggcagagccaccctgagcatcgacaccttcagaaaccagttcttcctgagactgaccagcatgaccgccgacgacaccgccgtgtactactgcgtgaagcacaagtaccacgacatcgtgatggtggtgcccatcgccggctggttcgacccctggggccagggcctgcaggtgaccgtgagccag

SEQ ID NO: 33413 - RNA, 399 nt, synthetic construct
  misc_feature 1..399: note = derived and/or modified sequence opt4 from anti-HIV-1_HeavyChain
  source 1..399: mol_type = other RNA
gaggtgcacctgcaggagagcggccccggcctggtgagacccctggagaccctgagcctgacctgcaccgccagcggcgccagcatcagaggcggcgagtggggcgacaacgactaccactggggctgggtgagacacagccccgagaagggcctggagtggatcggcagcatccactggagaggcaccacccactacaacgcccccttcagaggcagagccaccctgagcatcgacaccagcagaaaccagttcttcctgagactgaccagcatgaccgccgacgacaccgccgtgtactactgcgtgaagcacaagtaccacgacatcgtgatggtggtgcccatcgccggctggttcgacccctggggccagggcctgagaggcaccgtgagcgcc

SEQ ID NO: 33414 - RNA, 393 nt, synthetic construct
  misc_feature 1..393: note = derived and/or modified sequence opt4 from anti-HIV-1_HeavyChain
  source 1..393: mol_type = other RNA
caggtgcagctggtgcagagcggcgccgtgatcaagacccccggcagcagcgtgaagatcagctgcagagccagcggctacaacttcagagactacagcatccactgggtgagactgatccccgacaagggcttcgagtggatcggctggatcaagcccctgtggggcgccgtgagctacgccagacagctgcagggcagagtgagcatgaccagacagctgagcagagaccccgacgaccccgactggggcgtggcctacatggagttcagcggcctgacccccgccgacaccgccgagtacttctgcgtgagaagaggcagctgcgactactgcggcgacttcccctggcagtactggggccagggcaccgtggtggtggtgagcagcgcc

SEQ ID NO: 33415 - RNA, 393 nt, synthetic construct
  misc_feature 1..393: note = derived and/or modified sequence opt4 from anti-HIV-1_HeavyChain
  source 1..393: mol_type = other RNA
caggtgcagctggtgcagagcggcgccgtgatcaagacccccggcagcagcgtgaagctgagctgcagagccagcggctacaacttcagagactacagcatccactgggtgagactgatccccgacaagggcttcgagtggatcggctggatcaagcccctgtggggcgccgtgagctacgccagacagctgcagggcagagtgagcatgaccagacagctgagccaggaccccgacgaccccgactggggcgtggcctacatggagttcagcggcctgacccccgccgacaccgccgagtacttctgcgtgagaagaggcagctgcgactactgcggcgacttcccctggcagtactggggccagggcaccgtggtggtggtgagcagcgcc

SEQ ID NO: 33416 - RNA, 303 nt, synthetic construct
  misc_feature 1..303: note = derived and/or modified sequence opt4 from anti-HIV-1_LightChain
  source 1..303: mol_type = other RNA
accgccggcctgacccagagccccggcaccctgagcctgagccccggcgagagagccatcctgagctgcagaaccagccagtacggcagcctggcctggtaccagcagagacccggccaggcccccagactggtgatctacgccggcctgaccagagccaccggcatccccgacagattcagcggcagcagatggggcgccgagtacaacctgaccatcagcaacctggagagcgaggacttcggcgtgtactactgccagcagtacgacttcttcggccagggcaccaaggtgcaggtggac

SEQ ID NO: 33417 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgcc

SEQ ID NO: 33418 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgagaagtacaccggcggccagggctggtacttcgacctgtggggcagaggcaccctgatcgtggtgagcagcgcc

SEQ ID NO: 33419 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgcc

SEQ ID NO: 33420 - RNA, 387 nt, synthetic construct
  misc_feature 1..387: note = derived and/or modified sequence opt4 from anti-HIV-1_HeavyChain
  source 1..387: mol_type = other RNA
caggtgcagctggtgcagagcggcgccgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagcgcc

SEQ ID NO: 33421 - RNA, 387 nt, synthetic construct
  misc_feature 1..387: note = derived and/or modified sequence opt4 from anti-HIV-1_HeavyChain
  source 1..387: mol_type = other RNA
caggtgcagctggtgcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgcc

SEQ ID NO: 33422 - RNA, 387 nt, synthetic construct
  misc_feature 1..387: note = derived and/or modified sequence opt4 from anti-HIV-1_HeavyChain
  source 1..387: mol_type = other RNA
caggtgcagctggtgcagagcggcctggaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgcc

SEQ ID NO: 33423 - RNA, 387 nt, synthetic construct
  misc_feature 1..387: note = derived and/or modified sequence opt4 from anti-HIV-1_HeavyChain
  source 1..387: mol_type = other RNA
caggtgcagctggtgcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagagacagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgcc

SEQ ID NO: 33424 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcagcggcgtgaagaagcccggcgccagcgtgagagtgagctgctggaccagcgagggcatcttcgagaagagcgagctgatccactgggtgagacaggcccccggccagggcctggagtggatcggctgggtgaagaccgtgaccggcgccgtgaacttcggccaccagatcagcgacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgcc

SEQ ID NO: 33425 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgaggtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgcc

SEQ ID NO: 33426 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgaggtgaagagacccggcgccagcgtgaaggtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgcc

SEQ ID NO: 33427 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttcatgagcggcggccagggctggtacttcgacctgtggggcagaggcaccgtgatcgtggtgagcagcgcc

SEQ ID NO: 33428 - RNA, 387 nt, synthetic construct
  misc_feature 1..387: note = derived and/or modified sequence opt4 from anti-HIV-1_HeavyChain
  source 1..387: mol_type = other RNA
caggtgcagctggtgcccagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgcc

SEQ ID NO: 33429 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttctacgccggcggccagggctggtacttcgacctgtggggcagaggcaccctgatcgtggtgagcagcgcc

SEQ ID NO: 33430 - RNA, 387 nt, synthetic construct
  misc_feature 1..387: note = derived and/or modified sequence opt4 from anti-HIV-1_HeavyChain
  source 1..387: mol_type = other RNA
caggtgcagctggtgcagagcggcgccgaggtgaagaagcccggcagcagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcagatacagcggcgaccagggcagctacttcgacctgtggggcagaggcaccctgatcatcgtgagcagcgcc

SEQ ID NO: 33431 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatcggctgggtgaagcccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgcc

SEQ ID NO: 33432 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgcaggtgagctgcaaggccagcggctaccccttcaccaagtactacatgcactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgcc

SEQ ID NO: 33433 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgaaggtgagctgcaaggccagcggctacaccttcaccggctactacatgcactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgcc

SEQ ID NO: 33434 - RNA, 402 nt, synthetic construct
  misc_feature 1..402: note = derived and/or modified sequence opt4 from anti-HIV-1_HeavyChain
  source 1..402: mol_type = other RNA
caggtgcagctggtgcagagcggcagcggcgtgaagaagcccggcgccagcgtgagagtgagctgcagagccagcgaggacctgttcggcgacgagatcatctacgacgacgaggtgatccactggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgcc

SEQ ID NO: 33435 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcggcggcgtgaagaagcccggcgccagcgccagcttcagctgcagaaccagcgaggaccccttcgacaacgagttcttcgacagcgagttcatgcactgggtgagactgacccccggccagagacccgagtggatgggctggatgaaccccagaagcggcggcgtgaactacgccggccagttcagacccagaatgagcatgtggagagacagagagctgagcaccgcctacatggagctgagagacctgaccttcgccgacaccggcctgtacttctgcgccagaagaaaggaggacgactacgactggtactacgacctgtggggcagaggcgcccacatcatcgtgagcgccgcc

SEQ ID NO: 33436 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgcc

SEQ ID NO: 33437 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcgccgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgcc

SEQ ID NO: 33438 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcgaggccgaggtgaagaagcccggcgccagcatgaccgtgagctgcgagaccgccgacgaggacatcttcgacgccgcctacatgcactgggtgagacaggcccccggccagaccttcgagtggctgggctggatgaagcccgtgaccggcgccgtgaactacgccagaaagttccagggcagaatcagcttctacagaaccagagagctggccatcgcctacatggacctgagagacctgagattcgacgacaccgccgtgtacttctgcgccagaaagaccgccggcgacgtgagcggcgacaacagaggctacttcttcgacctgtggggcagaggcagcagagtgatcgtgagcagcgcc

SEQ ID NO: 33439 - RNA, 420 nt, synthetic construct
  misc_feature 1..420: note = derived and/or modified sequence opt4 from anti-HIV-1_HeavyChain
  source 1..420: mol_type = other RNA
cagagccacctggagcagagcggcagcgccatgaagaagcccggcgccagcgtgagagtgagctgctggaccagcgaggacatcttcgacaccaccgagctgctgtgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctactactgcgccagacagaagttcgccagcagatacagcggcgaccagggcagctacttcgacctgtggggcagaggcaccctgatcatcgtgagcagcgccagcaccaagggccccagcgtgttcccccacgacctg

SEQ ID NO: 33440 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaacggccccatcggcctgccccccagaagcgcc

SEQ ID NO: 33441 - RNA, 423 nt, synthetic construct
  misc_feature 1..423: note = derived and/or modified sequence opt4 from anti-HIV-1_HeavyChain
  source 1..423: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagcgccagcaccaagggccccagcagcagccccaccatctgc

SEQ ID NO: 33442 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 33443 - RNA, 411 nt, synthetic construct
  misc_feature 1..411: note = derived and/or modified sequence opt4 from anti-HIV-1_HeavyChain
  source 1..411: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcagcctgcaccagggccccagcggcctgccccacgac

SEQ ID NO: 33444 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 33445 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctactactgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 33446 - RNA, 384 nt, synthetic construct
  misc_feature 1..384: note = derived and/or modified sequence opt4 from anti-HIV-1_HeavyChain
  source 1..384: mol_type = other RNA
caggtgcacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33447 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 33448 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttccccaccatctgc

SEQ ID NO: 33449 - RNA, 411 nt, synthetic construct
  misc_feature 1..411: note = derived and/or modified sequence opt4 from anti-HIV-1_HeavyChain
  source 1..411: mol_type = other RNA
caggtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatcggctgggtgaagcccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccgtggtgttccccaccatctgc

SEQ ID NO: 33450 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33451 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctggatcaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33452 - RNA, 420 nt, synthetic construct
  misc_feature 1..420: note = derived and/or modified sequence opt4 from anti-HIV-1_HeavyChain
  source 1..420: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagaggcggccagggctggtacttcgacctgtggggcagaggcaccctgatcgtggtgagcagcgccagcaccgagggccccagcagaagcttcccccagatcctgaga

SEQ ID NO: 33453 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatctgcgtgagcagcgccagccccagagcccacagaagcagccccagaagcgcc

SEQ ID NO: 33454 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgaccagaggcgacaccgccacctactactgcgccagacagaagttcgagagcagatacaccggcggccagggctggtacttcgacctgtggggcagaggcacccacatcgtggtgagcagc

SEQ ID NO: 33455 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcatcgtgagcagc

SEQ ID NO: 33456 - RNA, 423 nt, synthetic construct
  misc_feature 1..423: note = derived and/or modified sequence opt4 from anti-HIV-1_HeavyChain
  source 1..423: mol_type = other RNA
cagagccacctggagcagagcggcagcgccatgaagaagcccggcgccagcgtgagagtgagctgctggaccagcgaggacatcttcgacaccaccagcatcttcatcggctgcgacagacccctggacaaggactggagcggcctgggcggcagcaagctgagcctggcccccagcatcttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctg

SEQ ID NO: 33457 - RNA, 399 nt, synthetic construct
  misc_feature 1..399: note = derived and/or modified sequence opt4 from anti-HIV-1_HeavyChain
  source 1..399: mol_type = other RNA
agagagtacctggagcagagcggcggcggcgtgaagaagctgggcgccagcgtgagagtgagctgcagagccagcgaggacctgttcggcgacgaggtgatctacgacgacgagctgatccactggctgagacaggtgcccggccagagacccgagtggatgggctggatcagacccaagaccggcgccagaaaccaggccagacagttccagcccagaatcaacctgagcagagacagagccctgaacaccgcctacctggacctgagcagcctgaccagcgccgacagcgccacctacttctgcgccagacagaccttcaagcccgacttctacttcgccgaccagggctggagcttcaacctgtggggcagaggcgccagagtgatcgtgagcagc

SEQ ID NO: 33458 - RNA, 384 nt, synthetic construct
  misc_feature 1..384: note = derived and/or modified sequence opt4 from anti-HIV-1_HeavyChain
  source 1..384: mol_type = other RNA
caggtgcacctggtgcagagcggcgccgaggtgaagaagcccggcagcagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcagatacagcggcgaccagggcagctacttcgacctgtggggcagaggcaccctgatcatcgtgagcagc

SEQ ID NO: 33459 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccaccatctgc

SEQ ID NO: 33460 - RNA, 441 nt, synthetic construct
  misc_feature 1..441: note = derived and/or modified sequence opt4 from anti-HIV-1_HeavyChain
  source 1..441: mol_type = other RNA
agagagttcctggagcagagcggcggcggcgtgaagaagctgggcgccagcctgagagtgagctgcagagccagcgaggacctgttcggcgacgagttcatctacgacgacgaggtgatccactggctgagacaggtgcccggccagagacccgagtggatgggctggatcagacccaagaccggcgccagaaaccaggccacccagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgccagcaccaagggccccagcgtgttcccccacgacagcgcc

SEQ ID NO: 33461 - RNA, 399 nt, synthetic construct
  misc_feature 1..399: note = derived and/or modified sequence opt4 from anti-HIV-1_HeavyChain
  source 1..399: mol_type = other RNA
agagagtacctggagcagagcggcggcggcgtgaagaagctgggcgccagcctgagagtgagctgcagagccagcgaggacctgttcggcgacgagatcatctacgacgacgaggtgatccactggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33462 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33463 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33464 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcaccggcgtgaagaagcccggcgccagcgtgagagtgagctgctggaccagcgaggacatcttcgagaagagcgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccagatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctg

SEQ ID NO: 33465 - RNA, 399 nt, synthetic construct
  misc_feature 1..399: note = derived and/or modified sequence opt4 from anti-HIV-1_HeavyChain
  source 1..399: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcggc

SEQ ID NO: 33466 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgacccacgacagagacctgttcaccgcccacatggacatcagaggcctgacccagggcgacaccgccacctacttctgcgccagacagaagttctacgccggcggccagggctggtacttcgacctgtggggcagaggcaccctgatctgcgtgagcagcgccagcaccaagggccccagcggcctgccccccagaagc

SEQ ID NO: 33467 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 33468 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagcgccagcaccaagggccccagcgtgttccccaccatctac

SEQ ID NO: 33469 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctactactgcgccagacagaagttcgagagcagatacaccggcggccagggctggtacttcgacctgtggggcagaggcacccacatcgtggtgagcagc

SEQ ID NO: 33470 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctactactgcgccagacagaagttctacaagggcggccagggctggtacttcgacctgtggggcagaggcaccctgatcgtggtgagcagcgccagcaccaagggccccagcgtgttccccaccatctgc

SEQ ID NO: 33471 - RNA, 399 nt, synthetic construct
  misc_feature 1..399: note = derived and/or modified sequence opt4 from anti-HIV-1_HeavyChain
  source 1..399: mol_type = other RNA
agagagtacctggagcagagcggcggcggcgtgaagaagcccggcgccagcgtgagagtgagctgcagagccagcgaggacctgttcggcgacgagatcatctacgacgacgaggtgatccactggctgagacaggtgcccggccagagacccgagtggatgggctggatcagacccaagaacggcggcagaaaccaggccagacagttccagcccagaatcagcctgaccagagacagagccctgaacaccgcctacctggacctgaacagcctgaccagcgccgacagcggcacctacttctgcgccagacagaccttcaagcccgacttctacttcgccgaccagggctggagcttcaacctgtggggcagaggcgccagagtgatcgtgagcagc

SEQ ID NO: 33472 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33473 - RNA, 420 nt, synthetic construct
  misc_feature 1..420: note = derived and/or modified sequence opt4 from anti-HIV-1_HeavyChain
  source 1..420: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttccccaccatctgc

SEQ ID NO: 33474 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagagcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 33475 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagccccaagggccccagcggcctgccccccagaagcgcc

SEQ ID NO: 33476 - RNA, 411 nt, synthetic construct
  misc_feature 1..411: note = derived and/or modified sequence opt4 from anti-HIV-1_HeavyChain
  source 1..411: mol_type = other RNA
caggtgcagctggtgcagagcggcgccgaggtgaagaagcccggcgccagcgtgaaggtgagctgcaaggccagcggctacaccttcaccacctacggcatcagctgggtgagacaggcccccggccagggcctggagtggatcggctgggtgaagaccgtgaccggcgccgtgaacttcggccaccagatcagcgacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 33477 - RNA, 417 nt, synthetic construct
  misc_feature 1..417: note = derived and/or modified sequence opt4 from anti-HIV-1_HeavyChain
  source 1..417: mol_type = other RNA
caggcccagctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 33478 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagc

SEQ ID NO: 33479 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttcgagagcagatacaccggcggccagggctggtacttcgacctgtggggcagaggcacccacatcgtggtgagcagc

SEQ ID NO: 33480 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttccccaccatctgc

SEQ ID NO: 33481 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgcagaagcccggcgccagcgtgaccgtgagctgcaaggccagcggctacaccctgatcagctacggcatcagctgggtgagacaggcccccggccagggccccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33482 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcctgagaaagaaggagctgatccactgggtgagacaggcccccggccagggcctggagtggatcggctgggtgaagaccgtgaccggcaccgtgaacttcggcagcagcgacttcagacagagagtgagcctgaccagagacagagacctgttcaccgcccacatggacatcagaggcctgacccagggcgacaccgccacctacctgtgcgccagacagaagttcgagagaggcggccagggctggatcttcgacctgtggggcagaggcaccctgatcgccgtgagcagcgccagcaccaagggccccagcgtgttcccccacgacctg

SEQ ID NO: 33483 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaacggccccatcggcctgccccacagaagcgcc

SEQ ID NO: 33484 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcggcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagc

SEQ ID NO: 33485 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcggcctgccccacggcagcgcc

SEQ ID NO: 33486 - RNA, 423 nt, synthetic construct
  misc_feature 1..423: note = derived and/or modified sequence opt4 from anti-HIV-1_HeavyChain
  source 1..423: mol_type = other RNA
caggtgcagtacggcagagaggccggcgccggcatgaagaagcccggcgccagcatgaccgtgagctgcaagaccgccgacgaggacatcttcgacgccgcctacatgcacagagtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttccccaccatctac

SEQ ID NO: 33487 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 33488 - RNA, 423 nt, synthetic construct
  misc_feature 1..423: note = derived and/or modified sequence opt4 from anti-HIV-1_HeavyChain
  source 1..423: mol_type = other RNA
caggtgcagctggtgcagagcgaggccgagctgaagaagcccggcgccagcgtgagcgtgagctgcaaggccagcggctacagcttcaccagctacggcatcagctgggtgagacaggtgcccggccagggcctggagtggatcgcctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgccagcaccaagggccccagcgtgttcccccacgacctgaga

SEQ ID NO: 33489 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagcgccagcaccaagggccccagcgtgttcccccacgacctg

SEQ ID NO: 33490 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgcagaagcccggcgccagcgtgaccgtgagctgcaaggccagcggctacaccctgatcagctacggcatcagctgggtgagacaggcccccggccagggccccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctactactgcgccagacagaccttcaagcccgacttctacttcgccgaccagggctggagcttcaacctgtggggcagaggcgcccacttcatcgtgagcagc

SEQ ID NO: 33491 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccagatctgc

SEQ ID NO: 33492 - RNA, 378 nt, synthetic construct
  misc_feature 1..378: note = derived and/or modified sequence opt4 from anti-HIV-1_HeavyChain
  source 1..378: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatctgcgtgagcagcgcc

SEQ ID NO: 33493 - RNA, 438 nt, synthetic construct
  misc_feature 1..438: note = derived and/or modified sequence opt4 from anti-HIV-1_HeavyChain
  source 1..438: mol_type = other RNA
cagggctacctggcccagagcggcggcggcgtgaagaagcccggcaccagcgccagcttcagctgcagaaccagcgacgacatctacgacaacgagttcttcgacagcgccttcatgcactgggtgagactgatccccggccagagacccgagtggatgggctggatgaaccccagaagcggcgccgtgaactacgccagacagctgcagcccagagtgagcatgtacagagacagagacctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgccagcaccaagggccccagcgtgctgccccacgacctgaga

SEQ ID NO: 33494 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgacccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccagaagcgcc

SEQ ID NO: 33495 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagaagaaggagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctg

SEQ ID NO: 33496 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctactactgcgccagacagaagttcgagagcagatacaccggcggccagggctggtacttcgacctgtggggcagaggcacccacatcgtggtgagcagc

SEQ ID NO: 33497 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagcgccagcaccaagggccccagcgtgttccccaccatctgc

SEQ ID NO: 33498 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 33499 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 33500 - RNA, 408 nt, synthetic construct
  misc_feature 1..408: note = derived and/or modified sequence opt4 from anti-HIV-1_HeavyChain
  source 1..408: mol_type = other RNA
caggtgcagctggtgcacagcggcgccgaggtgaagaagcccggcgccagcatgaaggtgagctgcaagaccagcggctacagcttcaccggctactacatgcactgggtgagacaggcccccggccagggcctggagtggatgggctggatcaaccccagcagcaacgacaccaactacgcccagaagttccagggcagagtgaccatgaccagagacaccagcatcaacaccgcctacatggagctgagcagactgagaagcggcgacaccgccatctacttctgcgccagacagaagttctacgccggcggccagggctggtacttcgacctgtggggcagaggcaccctgatcgtggtgagcagcgccagcaccaagggccccagcgtgttccccaccatctgc

SEQ ID NO: 33501 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaagattccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33502 - RNA, 414 nt, synthetic construct
  misc_feature 1..414: note = derived and/or modified sequence opt4 from anti-HIV-1_HeavyChain
  source 1..414: mol_type = other RNA
cagggcaccctggagcagagctggagcgaggtgaagaagctgggcgccagcgtgagagtgagctgctggaccagcgaggacatcttcaagaccgagctgatccactgggtgagacaggcccccggccagggcctggagtggatcggcggcatgaaggccgtgagcggcgccgtgaactacggcagcctggacttcagacacagagtgagcctgacccccgacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 33503 - RNA, 423 nt, synthetic construct
  misc_feature 1..423: note = derived and/or modified sequence opt4 from anti-HIV-1_HeavyChain
  source 1..423: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatctgcgtgagcagcgccagcaccagagcccacagactgccccccagaagcgcc

SEQ ID NO: 33504 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagccccagagcccacagaagcagccccagaagcgcc

SEQ ID NO: 33505 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacagcgcc

SEQ ID NO: 33506 - RNA, 414 nt, synthetic construct
  misc_feature 1..414: note = derived and/or modified sequence opt4 from anti-HIV-1_HeavyChain
  source 1..414: mol_type = other RNA
caggcccacctggtgcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 33507 - RNA, 414 nt, synthetic construct
  misc_feature 1..414: note = derived and/or modified sequence opt4 from anti-HIV-1_HeavyChain
  source 1..414: mol_type = other RNA
caggcccagctggagcagagcggcagcggcgtgaagaagcccggcgccagcgtgagagtgagctgctggaccagcgaggacatcttcaagaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 33508 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagagaggtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 33509 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagaatcagcctgaccagagacagagacctgttcaccgcccacatggacatcagaggcctgacccagggcgacaccgccacctactactgcgccagacagaagttcgagagcagatacaccggcggccagggctggtacttcgacctgtggggcagaggcacccacatcgtggtgagcagc

SEQ ID NO: 33510 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctactactgcgccagacagaagttctacaagggcggccagggctggtacttcgacctgtggggcagaggcaccctgatcgtggtgagcagc

SEQ ID NO: 33511 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcaaggccagcggctacaccttcaccgactactacctgcactgggtgagacaggcccccggccagggcctggactgggtgggctggatcaaccccaacagcggcggcaccaactacgcccagaagttccagggcagagtggccatgaccagagacaccagcctgagcagcgtgtacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33512 - RNA, 414 nt, synthetic construct
  misc_feature 1..414: note = derived and/or modified sequence opt4 from anti-HIV-1_HeavyChain
  source 1..414: mol_type = other RNA
caggccgacctggagcagagcggcagcggcgtgaagaagcccggcgccagcgtgagagtgagctgctggaccagcgaggacatcttcgagagaaccaactacgtgcactgggtgagacaggcccccggcagaggcctggagtggatcggctggagcaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctg

SEQ ID NO: 33513 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33514 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 33515 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagctgggcgccagcgtgagagtgagctgctggaccagcgaggacatcttcgagagaaccaacctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctg

SEQ ID NO: 33516 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccggcgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33517 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcaccgtgagcagc

SEQ ID NO: 33518 - RNA, 429 nt, synthetic construct
  misc_feature 1..429: note = derived and/or modified sequence opt4 from anti-HIV-1_HeavyChain
  source 1..429: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcggcctgccccccaccatctgcaga

SEQ ID NO: 33519 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 33520 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 33521 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagaggcagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 33522 - RNA, 411 nt, synthetic construct
  misc_feature 1..411: note = derived and/or modified sequence opt4 from anti-HIV-1_HeavyChain
  source 1..411: mol_type = other RNA
caggcccacctgggcgccaactggagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccagatc

SEQ ID NO: 33523 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33524 - RNA, 423 nt, synthetic construct
  misc_feature 1..423: note = derived and/or modified sequence opt4 from anti-HIV-1_HeavyChain
  source 1..423: mol_type = other RNA
caggcccagctggagcagagcggcgtgggcgtgaagaagcccggcgccagcgtgagagtgagctgcctggccagcgaggacatcttcaagaccgagctgatccactgggtgagacaggcccccggccagggcctggagtggatcggctgggtgaagaccgtgaccggcgccgtgaacttcggcagccagatcttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 33525 - RNA, 411 nt, synthetic construct
  misc_feature 1..411: note = derived and/or modified sequence opt4 from anti-HIV-1_HeavyChain
  source 1..411: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcgcccaccagatcagcgacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctgc

SEQ ID NO: 33526 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatctgcgtgagcagc

SEQ ID NO: 33527 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33528 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33529 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgagggcgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33530 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33531 - RNA, 378 nt, synthetic construct
  misc_feature 1..378: note = derived and/or modified sequence opt4 from anti-HIV-1_HeavyChain
  source 1..378: mol_type = other RNA
caggtgtacatggagcagcccggcgtggaggtgaccaagcccggcgccagcgtgaccctgagctgcaagaccgccgaggacgtgttcgacgccgcctacatgcactgggtgagacaggcccccggccagaccttcgagtggctgggctggatcaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33532 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcatcgtgagcagc

SEQ ID NO: 33533 - RNA, 384 nt, synthetic construct
  misc_feature 1..384: note = derived and/or modified sequence opt4 from anti-HIV-1_HeavyChain
  source 1..384: mol_type = other RNA
caggcccacctggtgcagagcggcagcgaggtgaagaagcccggcgccttcgtgagagtgagctgctggaccagcgaggacatcttcgaggagaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33534 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgcaaggccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33535 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcgaggtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33536 - RNA, 375 nt, synthetic construct
  misc_feature 1..375: note = derived and/or modified sequence opt4 from anti-HIV-1_HeavyChain
  source 1..375: mol_type = other RNA
caggcccacctggtgcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33537 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgagagaggcggccagggctggtacttcgacctgtggggcagaggcaccctgatctgcgtgagcagc

SEQ ID NO: 33538 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccagagccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33539 - RNA, 381 nt, synthetic construct
  misc_feature 1..381: note = derived and/or modified sequence opt4 from anti-HIV-1_HeavyChain
  source 1..381: mol_type = other RNA
caggtgcagctggagcaggccggcgccggcgtgaagaagcccggccccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33540 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33541 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcgccggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33542 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagccagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33543 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggccagaggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33544 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcgccggcgtgaaggagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgctgaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33545 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 33546 - RNA, 384 nt, synthetic construct
  misc_feature 1..384: note = derived and/or modified sequence opt4 from anti-HIV-1_HeavyChain
  source 1..384: mol_type = other RNA
caggcccacctggtgcagagcgccagcggcgtgaagagacccggcgccagcgtgagagtgagctgctggaccagcgaggacatcttcgagagaaccgagctgatctactgggtgagacaggcccccggccagggcctggagtggatcggctgggtgaagaccgtgagcggcgccgtgaacttcggcagccaggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33547 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33548 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagggctacatgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33549 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatctgcgtgagcagc

SEQ ID NO: 33550 - RNA, 375 nt, synthetic construct
  misc_feature 1..375: note = derived and/or modified sequence opt4 from anti-HIV-1_HeavyChain
  source 1..375: mol_type = other RNA
caggcccacctggtgcagagcggcagcggcgtgaagaagagcggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33551 - RNA, 378 nt, synthetic construct
  misc_feature 1..378: note = derived and/or modified sequence opt4 from anti-HIV-1_HeavyChain
  source 1..378: mol_type = other RNA
caggtgtacatggagagagccggcgccggcgtgaagaagcccggcgccagcgtgaccctgagctgcaagaccgccgacgaggacgtgttcggcgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33552 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33553 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33554 - RNA, 384 nt, synthetic construct
  misc_feature 1..384: note = derived and/or modified sequence opt4 from anti-HIV-1_HeavyChain
  source 1..384: mol_type = other RNA
caggcccacctggtgcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtggccggcgccgtgaacttcagcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33555 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagagcggcgccagcgccagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33556 - RNA, 369 nt, synthetic construct
  misc_feature 1..369: note = derived and/or modified sequence opt4 from anti-HIV-1_HeavyChain
  source 1..369: mol_type = other RNA
ctgctgcagctggtgcagagcggcgccgaggtgaagaagcccggcgccagcgtgaaggtgacctgcaaggccagcggctacaccttcaccggctacatccactgggtgagacaggcccccggccagggcctggagtggatcggctgggtgaaggccgtgagcggcgccgtgaactacggcagcctggacttcagacacagagtgagcctgacccacgacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33557 - RNA, 369 nt, synthetic construct
  misc_feature 1..369: note = derived and/or modified sequence opt4 from anti-HIV-1_HeavyChain
  source 1..369: mol_type = other RNA
caggtgcagctggtgcagagcggcgccgaggtgaagaagcccggcgccagcgtgaaggtgagctgcaaggccagcggctgcaccttcaccggctactacatgcactgggtgagacaggcccccggccagggcctggagtggatgggctggatcaaccccaacagcggcggcaccaactacgcccagaagttccagggcagagtgaccatgaccagagacaccagcatcagcaccgcctacatggagctgagcagactgagaagcgacgacaccgccgtgtactactgcgccagacagaagttcgccagaggcgaccagggctggttcttcgacctgtggggcagaggcaccctgatcgtggtgagcagc

SEQ ID NO: 33558 - RNA, 369 nt, synthetic construct
  misc_feature 1..369: note = derived and/or modified sequence opt4 from anti-HIV-1_HeavyChain
  source 1..369: mol_type = other RNA
caggtgcagctggtgcagagcggcaccgagctgagaaagcccggcgccagcgtgaaggtgagctgcaaggccagcggctacaccttcagcggcagctacatccactgggtgagacaggcccccggccagggcctggagtgggtgggctggatcaaccccagcagcggcgccacccagtgcgccaagaagttccaggacaaggtgaccatgaccagagacaccaccaacaacaccgtgtacatggaggtgaacagactgatcagcgacgacaccgccacctacttctgcgccagacagaagttcgccagaggcgaccagggctggttcttcgacctgtggggcagaggcaccctgatcgtggtgagcagc

SEQ ID NO: 33559 - RNA, 372 nt, synthetic construct
  misc_feature 1..372: note = derived and/or modified sequence opt4 from anti-HIV-1_HeavyChain
  source 1..372: mol_type = other RNA
caggtgctgctggtgcagagcggcgccgaggtgaagaagcccggcagcagcgtgaaggtgagctgcaagaccagcggcgacagcctgaccaagtacgccctgcactgggccagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33560 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcaccgaggtgaagacccccggcgccagcgtgaaggtgagctgcaaggccagcggctacaccttcaccaactacgacatcaactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33561 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgacgaggtgaagaagcccggcgccagcgtgaaggtgagctgcaaggccagcggcaagggcttccccaccagcctggtgacctgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33562 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcagcagcgtgaaggtgagctgcaagaccagcggcgacatcctgaccaactacggcctgaactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33563 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgagagtgagctgcaagaccagcggctaccccttcagcagatacggcatcagctgggtgagacaggcccccggccagggcctggtgtggatggcctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33564 - RNA, 372 nt, synthetic construct
  misc_feature 1..372: note = derived and/or modified sequence opt4 from anti-HIV-1_HeavyChain
  source 1..372: mol_type = other RNA
agagagcagctggtgcagagcggcgccgaggtgaagaagcccggcgccagcgtgaaggtgagctgcaagaccagcggcaacaccttcggcagctacgacttcaactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33565 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33566 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgaaggtgagctgcaaggccagcggctacaccttcaccagctactacatgcactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33567 - RNA, 372 nt, synthetic construct
  misc_feature 1..372: note = derived and/or modified sequence opt4 from anti-HIV-1_HeavyChain
  source 1..372: mol_type = other RNA
caggtgcagctgggccagagcggcgccgagatgaagaagcccggcagcagcgtgaaggtgagctgcaaggccagcggcggcaccttcagacacagccccatcagctgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33568 - RNA, 369 nt, synthetic construct
  misc_feature 1..369: note = derived and/or modified sequence opt4 from anti-HIV-1_HeavyChain
  source 1..369: mol_type = other RNA
caggtgcagctggtgcagagcggcgccgaggtgagaacccccggcgccagcgtgaaggtgagctgcaaggccagcggctacaacttcatcgcctaccacgtgcactgggtgagacaggcccccggccagggcctgacctggatgggctggatcaaccccgacagcggcgacaccgtgtacgcccagaacttcgtggacagagtgatgatgaccagaaacaccagcatccagaccgtgtacctggagctgaacgtgctgaccctggaggacaccgccacctacttctgcgccagacagaagttcgccagaggcgaccagggctggttcttcgacctgtggggcagaggcaccctgatcgtggtgagcagc

SEQ ID NO: 33569 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgaaggtgagctgcaaggccagcggctacaccttcaccgtgtactacatgcactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33570 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33571 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgaaggtgagctgcaaggccagcggctacaccttcatcggctactacatgcactgggtgagacaggcccccggccagggcctggagtggatgggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33572 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33573 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagctgggcgccagcgtgagagtgagctgctggaccagcgaggacatcttcaaggacagaatcgaccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33574 - RNA, 375 nt, synthetic construct
  misc_feature 1..375: note = derived and/or modified sequence opt4 from anti-HIV-1_HeavyChain
  source 1..375: mol_type = other RNA
caggtgcagctggcccagagcggcgccgaggtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33575 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcagcaaggccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33576 - RNA, 372 nt, synthetic construct
  misc_feature 1..372: note = derived and/or modified sequence opt4 from anti-HIV-1_HeavyChain
  source 1..372: mol_type = other RNA
accgcccacctggagcagagcggcagcggcgtgagaagacccggcgccagcgtgagagtgagctgctggaccagcggcgacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33577 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagagacccggcgccagcgtgagagtgagctgctggaccagcgaggacatcttcaacaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33578 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33579 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgagagtgagctgcaaggccagcggctacaccttcaccgcctactacatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33580 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcgagagcaagaagcccggcgccagcgtgagagtgagctgctggagcagcgaggacatcttcaagaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33581 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcgaggtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33582 - RNA, 372 nt, synthetic construct
  misc_feature 1..372: note = derived and/or modified sequence opt4 from anti-HIV-1_HeavyChain
  source 1..372: mol_type = other RNA
caggcccacctggagcaggtgtgggccggcgtgaagaagctgggcgccagcgtgagagtgagctgctggaccagcgaggacatcttcaagaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33583 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagcaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33584 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33585 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33586 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcggcggcatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33587 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33588 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33589 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33590 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33591 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacctggtgcaccagatcagcgacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33592 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagaggcagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33593 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33594 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33595 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33596 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33597 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgagcggcgccgtgaacctggcccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33598 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacggcgacctgttcaccgcccacatggacatcagaggcctgacccagggcgacaccgccacctacttctgcgccagacagaagttctacgccggcggccagggctggtacttcgacctgtggggcagaggcaccctgatcatcgtgagcagc

SEQ ID NO: 33599 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagcgacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33600 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33601 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33602 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggccaccagatcagcgacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33603 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33604 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagctgggcgccagcgtgagagtgagctgctggaccagcgaggacatcctgaagaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33605 - RNA, 372 nt, synthetic construct
  misc_feature 1..372: note = derived and/or modified sequence opt4 from anti-HIV-1_HeavyChain
  source 1..372: mol_type = other RNA
gtgagaagcgtggtgcagtgcgaggccggcgtgaagaagcccggcgccagcgtgaagatcagctgcgccaccagcggctacgccttcaccctgtactacctgcactgggtgagacaggcccccggccagggcctggagtggatcggctgggtgaagaccgtgaccggcgccgtgaacttcggcagcgcctacttcagacacagagtgagcctgacccccgacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33606 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgcctggacagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33607 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33608 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgaagagcagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33609 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33610 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctggatgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33611 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcgaggtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33612 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagctgggcgccagcgtgagagtgagctgctggaccagcggcgacatcttcgagagaaccgagctgatccactgggtgagacaggcccccggccagggcctggagtggatcggctgggtgaaggccgtgagcggcgccgtgaactacggcagcctggacttcagacagagagtgagcctgaccagagacagagacctgttcaccgcccacatcgacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33613 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctgggccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33614 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagccagaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33615 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33616 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcctgagaaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33617 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33618 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33619 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33620 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagagacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33621 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcagaagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaacttcggcagccccaacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33622 - RNA, 375 nt, synthetic construct
  misc_feature 1..375: note = derived and/or modified sequence opt4 from anti-HIV-1_HeavyChain
  source 1..375: mol_type = other RNA
cagagctacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33623 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33624 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33625 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33626 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33627 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33628 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33629 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33630 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33631 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33632 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33633 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33634 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagctgggcgccagcgtgagagtgagctgctggaccagcgaggacatcttcgagagaaccgagctgatccactgggtgagacaggcccccggccagggcctggagtggatcggctggatgaaggccgtgagcggcgccgtgaactacggcagcctggacttcagacacagagtgagcctgaccagagacagagacctgagcaccgcccacatcgacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33635 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33636 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33637 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33638 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatgggcatcagaggcctgacccagggcgacaccgccacctacttctgcgccagacagaagttctacgccggcggccagggctggtacttcgacctgtggggcagaggcaccctgatcgtggtgagcagc

SEQ ID NO: 33639 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgttcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33640 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33641 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccaggacttcagagacagattcagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33642 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacgccaccggcctgatctactgggtgagacaggcccccggccagggcctggagtggatcggctgggtgaagatcgtgagcggcaccgtgaacttcgccagcctggacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33643 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcctacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33644 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacctgtgcgccagacagaagttcgccagaggcgaccagggctggttcttcgacctgtggggcagaggcaccctgatcgtggtgagcagc

SEQ ID NO: 33645 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33646 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33647 - RNA, 375 nt, synthetic construct
  misc_feature 1..375: note = derived and/or modified sequence opt4 from anti-HIV-1_HeavyChain
  source 1..375: mol_type = other RNA
caggcccaccccgagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33648 - RNA, 375 nt, synthetic construct
  misc_feature 1..375: note = derived and/or modified sequence opt4 from anti-HIV-1_HeavyChain
  source 1..375: mol_type = other RNA
agagcccacctggagcagagcggcagcggcgtgagaaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33649 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33650 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33651 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcacccacatcgtggtgagcagc

SEQ ID NO: 33652 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33653 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33654 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33655 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgaccgagggcgacaccgccacctacttctgcgccagacagaagttctacgccggcggccagggctggtacttcgacctgtggggcagaggcaccctgatcgtggtgagcagc

SEQ ID NO: 33656 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgccaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33657 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33658 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33659 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacctgtgcgccagacagaagttcgagagaggcggccagggctggatcttcgacctgtggggcagaggcaccctgatcgccgtgagcagc

SEQ ID NO: 33660 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33661 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33662 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgagcggcgccgtgaacttcggcagcaccgacttcagagagagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33663 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33664 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatctgcggcctgacccagggcgacaccgccacctacttctgcgccagacagaagttctacgccggcggccagggctggtacttcgacctgtggggcagaggcaccctgatcgtggtgagcagc

SEQ ID NO: 33665 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccgaggccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33666 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33667 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcgccagcgtgagagtgagctgctggaccagcgaggacatcttcgagagaaccgagctgatctactgggtgagacaggcccccggccagggcctggagtggatcggctgggtgaagaccgtgagcggcgccgtgaacttcggcagccaggacttcagagacagattcagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33668 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33669 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagaccccttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33670 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcggcctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33671 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaaggccgtgagcggcaccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33672 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33673 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33674 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacccacttctgcgccagacagaagttcgccagaggcgaccagggctggttcttcgacctgtggggcagaggcaccctgatcgtggtgagcagc

SEQ ID NO: 33675 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33676 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33677 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33678 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33679 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgagggcatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcgccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33680 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagagccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttctacgccggcggccagggctggtacttcgacctgtggggcagaggcaccctgatcgtggtgagcagc

SEQ ID NO: 33681 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33682 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctgaacttcagaagcagaatcagcctgaccagagacagagacctgttcaccgcccacatggacatcagaggcctgaccgagggcgacaccgccacctacttctgcgccagacagaagttctacgccggcggccagggctggtacttcgacctgtggggcagaggcaccctgatcgtggtgagcagc

SEQ ID NO: 33683 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33684 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcagatgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33685 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccagatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33686 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcgcccaccagatcagcgacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33687 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggtggtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33688 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33689 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33690 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33691 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacctgtgcgccagacagaagttcgagagaggcggccagggctggtacttcgacctgtggggcagaggcaccctgatcgtggtgagcagc

SEQ ID NO: 33692 - RNA, 372 nt, synthetic construct
  misc_feature 1..372: note = derived and/or modified sequence opt4 from anti-HIV-1_HeavyChain
  source 1..372: mol_type = other RNA
agacacacctgggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33693 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgaccgagggcgacaccgccacctacttctgcgccagacagaagttctacgccggcggccagggctggtacttcgacctgtggggcagaggcaccctgatcgtggtgagcagc

SEQ ID NO: 33694 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33695 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggccccggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33696 - RNA, 375 nt, synthetic construct
  misc_feature 1..375: note = derived and/or modified sequence opt4 from anti-HIV-1_HeavyChain
  source 1..375: mol_type = other RNA
agagcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33697 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33698 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33699 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33700 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgagctgaagaagcccggcagcagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33701 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgtgagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33702 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggtggtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33703 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccgcctacttctgcgccagacagaagttcgccagaggcgaccagggctggttcttcgacctgtggggcagaggcaccctgatcgtggtgagcagc

SEQ ID NO: 33704 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgagaaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33705 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33706 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33707 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33708 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33709 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagagacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33710 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33711 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33712 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagagacccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatgggcatcagaggcctgacccagggcgacaccgccacctacttctgcgccagacagaagttctacgccggcggccagggctggtacttcgacctgtggggcagaggcaccctgatcgtggtgagcagc

SEQ ID NO: 33713 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33714 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagctgggcgccagcgtgagagtgccctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33715 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33716 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33717 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33718 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33719 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttctacgccggcggccagggctggtacttcgacctgtggggcagaggcaccctgatcgtggtgagcagc

SEQ ID NO: 33720 - RNA, 375 nt, synthetic construct
  misc_feature 1..375: note = derived and/or modified sequence opt4 from anti-HIV-1_HeavyChain
  source 1..375: mol_type = other RNA
caggtgcagctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33721 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33722 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33723 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggaccggctgggtgaagaccgtgagcggcgccgtgaacttcggcagcaccgacttcagagagagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33724 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33725 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33726 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33727 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcggcaccgccacctacttctgcgccagacagaagttctacgccggcggccagggctggtacttcgacctgtggggcagaggcaccctgatcgtggtgagcagc

SEQ ID NO: 33728 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatctgcggcctgacccagggcgacaccgccacctacttctgcgccagacagaagttcgagagaggcggccagggctggtacttcgacctgtggggcagaggcaccctgatcgtggtgagcagc

SEQ ID NO: 33729 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgagaaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33730 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33731 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33732 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcctgagcgacttcagacagagagtgagcctgaccagagacagaggcctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33733 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33734 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgagagaggcggccagggctggtacttcgacctgtggggcagaggcaccctgatcgtggtgagcagc

SEQ ID NO: 33735 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33736 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcccacatggacatcagaggcctgacccaggacgacaccgccacctacttctgcgccagacagaagttcgagagaggcggccagggctggatcttcgacctgtggggcagaggcaccctgatcgccgtgagcagc

SEQ ID NO: 33737 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcaccgaggtgaagaagcccggcgccagcgtgagagtgagctgcaaggccagcggctacaccttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33738 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagaggcggccagggctggatcttcgacctgtggggcagaggcaccctgatcgccgtgagcagc

SEQ ID NO: 33739 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33740 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33741 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33742 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctggtgcactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33743 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33744 - RNA, 375 nt, synthetic construct
  misc_feature 1..375: note = derived and/or modified sequence opt4 from anti-HIV-1_HeavyChain
  source 1..375: mol_type = other RNA
caggcccacagagagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33745 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgcctggccagcgaggacatcttcaagaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33746 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgagagaggcggccagggctggatcttcgacctgtggggcagaggcaccctgatcgccgtgagcagc

SEQ ID NO: 33747 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33748 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33749 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33750 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33751 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33752 - RNA, 372 nt, synthetic construct
  misc_feature 1..372: note = derived and/or modified sequence opt4 from anti-HIV-1_HeavyChain
  source 1..372: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacctggcccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33753 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33754 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33755 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33756 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33757 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33758 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33759 - RNA, 375 nt, synthetic construct
  misc_feature 1..375: note = derived and/or modified sequence opt4 from anti-HIV-1_HeavyChain
  source 1..375: mol_type = other RNA
caggccagacccggcaccagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33760 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgaccgagggcgacaccgccacctacttctgcgccagacagaagttcgagagaggcggccagggctggatcttcgacctgtggggcagaggcaccctgatcgccgtgagcagc

SEQ ID NO: 33761 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccatcagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33762 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacagcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33763 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagagccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33764 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctggtgaccgtgagcagc

SEQ ID NO: 33765 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctgaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33766 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33767 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33768 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgccagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33769 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagaggcggccagggctggtacttcgacctgtggggcagaggcaccctgatcgtggtgagcagc

SEQ ID NO: 33770 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgagcggcgccgtgaacttcggcagcaccgacttcagagagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33771 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgtggtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33772 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33773 - RNA, 375 nt, synthetic construct
  misc_feature 1..375: note = derived and/or modified sequence opt4 from anti-HIV-1_HeavyChain
  source 1..375: mol_type = other RNA
caggcctacctggagcagagcggcagcatcatgaagaagcccggcgccagcgtgagagtgagctgctggaccagcgaggacatcttcgacagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33774 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagactggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33775 - RNA, 375 nt, synthetic construct
  misc_feature 1..375: note = derived and/or modified sequence opt4 from anti-HIV-1_HeavyChain
  source 1..375: mol_type = other RNA
gaggcccacctggagcagagcggcagcggcgtgaagaagcccggcgccagcgtgagagtgagctgctggaccagcgaggacatcttcgagagaaccgagctgacccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33776 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatctacgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33777 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33778 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33779 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcccccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33780 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgagagaggcggccagggctggatcttcgacctgtggggcagaggcaccctgatcgccgtgagcagc

SEQ ID NO: 33781 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgagaaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33782 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33783 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcgccctgatcgtggtgagcagc

SEQ ID NO: 33784 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33785 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33786 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcccacatggacatcagaggcctgacccaggacgacaccgccacctacttctgcgccagacagaagttctacgccggcggccagggctggtacttcgacctgtggggcagaggcaccctgatcgtggtgagcagc

SEQ ID NO: 33787 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33788 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33789 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacgccgccacctacttctgcgccagacagaagttcgagagaggcggccagggctggtacttcgacctgtggggcagaggcaccctgatcgtggtgagcagc

SEQ ID NO: 33790 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttctacgccggcggccagggctggtacttcgacctgtggggcagaggcaccctgatcgtggtgagcagc

SEQ ID NO: 33791 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcgccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33792 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctggcccagggcgacaccgccacctacttctgcgccagacagaagttcgagagaggcggccagggctggtacttcgacctgtggggcagaggcaccctgatcgtggtgagcagc

SEQ ID NO: 33793 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcccacatggacatcagaggcctgacccaggacgacaccgccacctacttctgcgccagacagaagttcgagagaggcggccagggctggtacttcgacctgtggggcagaggcaccctgatcgtggtgagcagc

SEQ ID NO: 33794 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33795 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33796 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagaagagcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33797 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33798 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33799 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33800 - RNA, 375 nt, synthetic construct
  misc_feature 1..375: note = derived and/or modified sequence opt4 from anti-HIV-1_HeavyChain
  source 1..375: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttctacgccggcggccagggctggtacttcgacctgtggggcagaggcaccctgatcgtggtgagcagc

SEQ ID NO: 33801 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccggcctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33802 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacgtgttcgagagaaccgagctgatccactgggtgagacaggcccccggccagggcctggagtggatcggctgggtgaagaccgtgatcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33803 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcgccggcgtgaagaagcccggcgccagcgtgagagtgagctgctggaccagcgaggacatcttcaagaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33804 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccgacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33805 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagaatcagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33806 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33807 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggaccggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33808 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggccccacccaggacgacaccgccacctacttctgcgccagacagaagttcgccagaggcgaccagggctggttcttcgacctgtggggcagaggcaccctgatcgtggtgagcagc

SEQ ID NO: 33809 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33810 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33811 - RNA, 375 nt, synthetic construct
  misc_feature 1..375: note = derived and/or modified sequence opt4 from anti-HIV-1_HeavyChain
  source 1..375: mol_type = other RNA
agacacacctggaacgagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33812 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33813 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33814 - RNA, 375 nt, synthetic construct
  misc_feature 1..375: note = derived and/or modified sequence opt4 from anti-HIV-1_HeavyChain
  source 1..375: mol_type = other RNA
caggcccacctgggcaccatcctgggcctggagagcaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccagcatcctggcccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33815 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagccctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33816 - RNA, 375 nt, synthetic construct
  misc_feature 1..375: note = derived and/or modified sequence opt4 from anti-HIV-1_HeavyChain
  source 1..375: mol_type = other RNA
agagtgcacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33817 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33818 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagagacccggcgccagcgtgaaggtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33819 - RNA, 375 nt, synthetic construct
  misc_feature 1..375: note = derived and/or modified sequence opt4 from anti-HIV-1_HeavyChain
  source 1..375: mol_type = other RNA
agacacgacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33820 - RNA, 375 nt, synthetic construct
  misc_feature 1..375: note = derived and/or modified sequence opt4 from anti-HIV-1_HeavyChain
  source 1..375: mol_type = other RNA
agacacacctgggagcaggtgtggagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33821 - RNA, 375 nt, synthetic construct
  misc_feature 1..375: note = derived and/or modified sequence opt4 from anti-HIV-1_HeavyChain
  source 1..375: mol_type = other RNA
agacacacctggaacaagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33822 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33823 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33824 - RNA, 375 nt, synthetic construct
  misc_feature 1..375: note = derived and/or modified sequence opt4 from anti-HIV-1_HeavyChain
  source 1..375: mol_type = other RNA
agacacgacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33825 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33826 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgcctggccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33827 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33828 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33829 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccacggcgacaccgccacctacttctgcgccagacagaagttcgagagaggcggccagggctggtacttcgacctgtggggcagaggcaccctgatcgtggtgagcagc

SEQ ID NO: 33830 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33831 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33832 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtggaggtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 33833 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcgccggcgtgaagaagctgggcgccagcgtgagagtgagctgctggaccagcgaggacatcttcaagaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33834 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33835 - RNA, 375 nt, synthetic construct
  misc_feature 1..375: note = derived and/or modified sequence opt4 from anti-HIV-1_HeavyChain
  source 1..375: mol_type = other RNA
agacacacctgggagagaatctggagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33836 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaagactgacccaggacgacaccgccacctacttctgcgccagacagaagttcgccagaggcgaccagggctggttcttcgacctgtggggcagaggcaccctgatcgtggtgagcagc

SEQ ID NO: 33837 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33838 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgacccccgacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33839 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33840 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctgggccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33841 - RNA, 375 nt, synthetic construct
  misc_feature 1..375: note = derived and/or modified sequence opt4 from anti-HIV-1_HeavyChain
  source 1..375: mol_type = other RNA
agacacacctgggagcaggtgtggagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33842 - RNA, 375 nt, synthetic construct
  misc_feature 1..375: note = derived and/or modified sequence opt4 from anti-HIV-1_HeavyChain
  source 1..375: mol_type = other RNA
agacacacctggagacagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgtggtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33843 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcggcgacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33844 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33845 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagagatgggccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33846 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33847 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagaggcctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33848 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgccaacttcggcagcagcgacttcagacagagagtgagcctgacccccgacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 33849 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgacaccaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33850 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcagagacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33851 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgcctggccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33852 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggcccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33853 - RNA, 375 nt, synthetic construct
  misc_feature 1..375: note = derived and/or modified sequence opt4 from anti-HIV-1_HeavyChain
  source 1..375: mol_type = other RNA
agagcccacctggagcagagcggcagcgagtggaagaagctgggcgccagcgtgagagtgagctgctggaccagcggcgacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33854 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagaagctgggcgccagcgtgaacgtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33855 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagcccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33856 - RNA, 375 nt, synthetic construct
  misc_feature 1..375: note = derived and/or modified sequence opt4 from anti-HIV-1_HeavyChain
  source 1..375: mol_type = other RNA
agacacacctggaacaagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33857 - RNA, 375 nt, synthetic construct
  misc_feature 1..375: note = derived and/or modified sequence opt4 from anti-HIV-1_HeavyChain
  source 1..375: mol_type = other RNA
caggcccacagcgagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33858 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagagacccggcgccagcgtgagagtgagctgctggaccagcgaggacatcttcgagaccaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33859 - RNA, 375 nt, synthetic construct
  misc_feature 1..375: note = derived and/or modified sequence opt4 from anti-HIV-1_HeavyChain
  source 1..375: mol_type = other RNA
ggccacacctgggagcagagcggcgccggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33860 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcgagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33861 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcgagagcggcagcggcgtgaagatgcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33862 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33863 - RNA, 375 nt, synthetic construct
  misc_feature 1..375: note = derived and/or modified sequence opt4 from anti-HIV-1_HeavyChain
  source 1..375: mol_type = other RNA
ggcacccccggcaacaagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33864 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33865 - RNA, 375 nt, synthetic construct
  misc_feature 1..375: note = derived and/or modified sequence opt4 from anti-HIV-1_HeavyChain
  source 1..375: mol_type = other RNA
ggcacccccggcaacaagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33866 - RNA, 375 nt, synthetic construct
  misc_feature 1..375: note = derived and/or modified sequence opt4 from anti-HIV-1_HeavyChain
  source 1..375: mol_type = other RNA
ggcacccccggcaacaagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 33867 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcggctgggtgagagtgagctgctggaccagcgaggacatcttcgagagaagcgagctgatctactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33868 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccagcagcggcgccgtgaacttcggcagccccaacttcagaaccagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33869 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33870 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33871 - RNA, 375 nt, synthetic construct
  misc_feature 1..375: note = derived and/or modified sequence opt4 from anti-HIV-1_HeavyChain
  source 1..375: mol_type = other RNA
ggcaccacctggaacaagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33872 - RNA, 375 nt, synthetic construct
  misc_feature 1..375: note = derived and/or modified sequence opt4 from anti-HIV-1_HeavyChain
  source 1..375: mol_type = other RNA
agacacacctggaacgagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33873 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcggcaacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33874 - RNA, 378 nt, synthetic construct
  misc_feature 1..378: note = derived and/or modified sequence opt4 from anti-HIV-1_HeavyChain
  source 1..378: mol_type = other RNA
agatgcagcatggagcagcccggctggagcgagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33875 - RNA, 375 nt, synthetic construct
  misc_feature 1..375: note = derived and/or modified sequence opt4 from anti-HIV-1_HeavyChain
  source 1..375: mol_type = other RNA
agacacaccagcgagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagc

SEQ ID NO: 33876 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33877 - RNA, 375 nt, synthetic construct
  misc_feature 1..375: note = derived and/or modified sequence opt4 from anti-HIV-1_HeavyChain
  source 1..375: mol_type = other RNA
ggcaccccctggaacgagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33878 - RNA, 375 nt, synthetic construct
  misc_feature 1..375: note = derived and/or modified sequence opt4 from anti-HIV-1_HeavyChain
  source 1..375: mol_type = other RNA
agacacgacctggagcccagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtg

SEQ ID NO: 33879 - RNA, 375 nt, synthetic construct
  misc_feature 1..375: note = derived and/or modified sequence opt4 from anti-HIV-1_HeavyChain
  source 1..375: mol_type = other RNA
agacacaccgtggagcagagcggcagcggcgtgaagaagctgggcgccagcgtgagagtgagctgcctggccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33880 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcgagagcaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33881 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcgagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagagacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33882 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagcccggcgccagcgtgagagtgagctgctggaccagcgaggacatcttcgagaagagcgagctgatccagtgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33883 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcgagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgccagaatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33884 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcgagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33885 - RNA, 372 nt, synthetic construct
  misc_feature 1..372: note = derived and/or modified sequence opt4 from anti-HIV-1_HeavyChain
  source 1..372: mol_type = other RNA
agagcccacctggagcagagcggcgccggcgtgaagaagcccggcggctgggtgagagtgagctgctggaccagcgaggacatcttcaagaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33886 - RNA, 378 nt, synthetic construct
  misc_feature 1..378: note = derived and/or modified sequence opt4 from anti-HIV-1_HeavyChain
  source 1..378: mol_type = other RNA
caggtgcagctgatgcagagcggcgccgaggtgaagagacccggcgccagcgtgaagatcagctgcaccgccagcggcttcaccctgaccgaccactacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33887 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgaggtgaagaagcccggcgccagcgtgaaggtgagctgcaaggccagcggctacaacttcaccggctactacctgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33888 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcaagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33889 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgagctgaagaagcccggcgccagcgtgaaggtgagctgcgaggccagcggctacagcttcaccgaccaccacatccactgggtgagacaggcccccggccagggcctggagtggctgggctggatgaaccccaacaacggcgacaccgcctacgcccagaccttcctgggcagagtgaccatgaccagagacaccagcatcaacaccgcctacatggagctgagcagactgaccagcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33890 - RNA, 378 nt, synthetic construct
  misc_feature 1..378: note = derived and/or modified sequence opt4 from anti-HIV-1_HeavyChain
  source 1..378: mol_type = other RNA
caggtgtacatgagcagcagaggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33891 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgaggtgaagaagcccggcgccagcgtgaaggtgagctgcaaggccagcggctacaccttcaccgcctactacatgcactggctgagacaggcccccggccagggcctggagtggatgggctggatcaacccccacagcggcggcaccaacttcgcccagaagttccagggcagagtgaccatgaccagagacaccagcatcaccaccgcctacatggagctgagcagactgagaagcgacgacaccgccacctacttctgcgccagacagaagttcgccagcagatacagcggcgaccagggcagctacttcgacctgtggggcagaggcaccctgatcgtggtgagcagc

SEQ ID NO: 33892 - RNA, 375 nt, synthetic construct
  misc_feature 1..375: note = derived and/or modified sequence opt4 from anti-HIV-1_HeavyChain
  source 1..375: mol_type = other RNA
agagcccacctggagcagagcggcgccggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 33893 - RNA, 378 nt, synthetic construct
  misc_feature 1..378: note = derived and/or modified sequence opt4 from anti-HIV-1_HeavyChain
  source 1..378: mol_type = other RNA
caggtgagactggtgcagagcggcgccgacgtgaagcagcccggcgccagcgtgaaggtgagctgcaaggccagcggctacaccttcaccgactactacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33894 - RNA, 378 nt, synthetic construct
  misc_feature 1..378: note = derived and/or modified sequence opt4 from anti-HIV-1_HeavyChain
  source 1..378: mol_type = other RNA
caggcccacctgggcaacaagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 33895 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagagcggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcaccagaaagaccgccggcgacgtgagcggcgacaagagaggcttcttcttcgacctgtggggcagaggcagcagagtgatcgtgagcagc

SEQ ID NO: 33896 - RNA, 381 nt, synthetic construct
  misc_feature 1..381: note = derived and/or modified sequence opt4 from anti-HIV-1_HeavyChain
  source 1..381: mol_type = other RNA
caggtgtacgtggagcagcccggcggcggcgtgaagaagcccggcgccagcgtgaccctgagctgcaagaccgccgacgaggacgtgttcgacgccacctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33897 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgtggaggtggagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33898 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33899 - RNA, 381 nt, synthetic construct
  misc_feature 1..381: note = derived and/or modified sequence opt4 from anti-HIV-1_HeavyChain
  source 1..381: mol_type = other RNA
caggtgcacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33900 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccgaggtgaagaagcccggcgccagcgtgaccctgagctgcgagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33901 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagcccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33902 - RNA, 372 nt, synthetic construct
  misc_feature 1..372: note = derived and/or modified sequence opt4 from anti-HIV-1_HeavyChain
  source 1..372: mol_type = other RNA
gccaccccctggaacaagagcggcagcggcgtgaagaagcccggcgccagcgtgagagtgagctgctggaccagcgaggacatcttcgagagaaccgagctgagcctggtgagacaggcccccggccagggcctggagtggatcggctggatgaagaccgtgaccggcgccgtgaacttcggcagccccaacttcagacacggcgtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33903 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcatgaagaagcccggcgccagcatgaccgccagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33904 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgaggtgaagaagcccggcgccagcgtgaaggtgagctgcaaggccagcggctacaccttcaccggctactacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaaggccgacgtgagcggcgacgacagaggcttcttcttcgacctgtggggcagaggcaccagagtgatcgtgagcagc

SEQ ID NO: 33905 - RNA, 381 nt, synthetic construct
  misc_feature 1..381: note = derived and/or modified sequence opt4 from anti-HIV-1_HeavyChain
  source 1..381: mol_type = other RNA
agagtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttcaccatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33906 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagagcggcggcggcgtgaagaagcccggccccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33907 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgaggtgaagaagcccggcgccagcgtgaaggtgagctgcaaggccagcggctacaccttcaccggctactacatccactggatgagacaggcccccggccagggcctggagtggatgggctggatcaaccccaacagcggcgccgtgagctacgccagaaagttccagggcagagtgagcttcctgcacgaccagggcatcagaatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33908 - RNA, 381 nt, synthetic construct
  misc_feature 1..381: note = derived and/or modified sequence opt4 from anti-HIV-1_HeavyChain
  source 1..381: mol_type = other RNA
caggtgcacatggagcaggccggcgtggaggtggagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33909 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcgtgaagaagcccggcgccagcgccaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33910 - RNA, 375 nt, synthetic construct
  misc_feature 1..375: note = derived and/or modified sequence opt4 from anti-HIV-1_HeavyChain
  source 1..375: mol_type = other RNA
ggccacgacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagc

SEQ ID NO: 33911 - RNA, 378 nt, synthetic construct
  misc_feature 1..378: note = derived and/or modified sequence opt4 from anti-HIV-1_HeavyChain
  source 1..378: mol_type = other RNA
caggcccacagaggcaccatctggggcctggaggtgaagaagcccggcggctgggtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 33912 - RNA, 381 nt, synthetic construct
  misc_feature 1..381: note = derived and/or modified sequence opt4 from anti-HIV-1_HeavyChain
  source 1..381: mol_type = other RNA
caggtgcacatggagcaggccggcgccggcgtggagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33913 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagagcggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33914 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagagcggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33915 - RNA, 381 nt, synthetic construct
  misc_feature 1..381: note = derived and/or modified sequence opt4 from anti-HIV-1_HeavyChain
  source 1..381: mol_type = other RNA
gaggtgtacatggagcagagcggcggcggcgtgaagaagcccggcgccagcgtgaccctgagctgcaagaccgccagcgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33916 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33917 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcagagcggcggcggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33918 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagaagattccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33919 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcgtgaagaagcccggcgccagcgtgaccctgagctgcaaggccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33920 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcgccggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33921 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagcccggcggcgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33922 - RNA, 381 nt, synthetic construct
  misc_feature 1..381: note = derived and/or modified sequence opt4 from anti-HIV-1_HeavyChain
  source 1..381: mol_type = other RNA
caggtgcacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33923 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggccccagagtgatcgtgagcagc

SEQ ID NO: 33924 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcaaggccagcggccacaccttcaccaactacgacatcaactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33925 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacaccgacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33926 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33927 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggcccggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33928 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgccaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33929 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgagatgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33930 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcagagccagcggctacaccttcggcaaccacgccatcagctgggtgagacaggcccccggccagggcctggagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33931 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggccccggcagcagagtgatcgtgagcagc

SEQ ID NO: 33932 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33933 - RNA, 381 nt, synthetic construct
  misc_feature 1..381: note = derived and/or modified sequence opt4 from anti-HIV-1_HeavyChain
  source 1..381: mol_type = other RNA
caggtgcacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33934 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgacggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33935 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaccctgagctgcaagaccgccgacgaggacgtgttcgacgccgcctacatgcactgggtgagacaggcccagggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33936 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagccaggtgatcgtgagcagc

SEQ ID NO: 33937 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgagaaagcccggcgccagcgtgaaggtgagctgcaaggccagcggctacaccttcaccaactactacatgcactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33938 - RNA, 381 nt, synthetic construct
  misc_feature 1..381: note = derived and/or modified sequence opt4 from anti-HIV-1_HeavyChain
  source 1..381: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33939 - RNA, 381 nt, synthetic construct
  misc_feature 1..381: note = derived and/or modified sequence opt4 from anti-HIV-1_HeavyChain
  source 1..381: mol_type = other RNA
ctgatccacctggcccagagcggcgccgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33940 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33941 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagggcagaggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33942 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagagcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33943 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcagcagcatcaaggtgagctgcaaggccagcggcgacaccatcagcagatacgccatcaactgggtgagacaggcccccggccagggcctggagtggatcggctgggtgaagaccgtgaccggcgccgtgaacttcggcagcctggacttcagacacagaatcagcctgaccagagacagagacctgttcaccgcccacatgggcatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33944 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacatcttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33945 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaacttccagggcagagtgagcttctacagaaccagagagctgggcatcgcctacatggacctgagaaacctgagattcgacgacaccgccgtgtacttctgcgccagacagaagttcgagagcagatacagcggcgaccagggcagctacttcgacctgtggggcagaggcaccctgatcatcgtgagcagc

SEQ ID NO: 33946 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagagacccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33947 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgacgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33948 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccggcgtgaagaagcccggcagcagcgtgaaggtgagctgcaaggccagcggcggcaccttcagcagctacgccatcaactggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33949 - RNA, 381 nt, synthetic construct
  misc_feature 1..381: note = derived and/or modified sequence opt4 from anti-HIV-1_HeavyChain
  source 1..381: mol_type = other RNA
caggtgtacatggagagagccggcggcggcgtgaagaagcccggcgccagcgtgaccctgagctgcgagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33950 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttcctgcaggaccagggcatcagaatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33951 - RNA, 381 nt, synthetic construct
  misc_feature 1..381: note = derived and/or modified sequence opt4 from anti-HIV-1_HeavyChain
  source 1..381: mol_type = other RNA
caggtgtacatgggcgccggcagaggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33952 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagcccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33953 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaagatcagctgcaaggccagcggctacaccttcatcagacacggcatccactggctgagacaggtgcccggccagagacccgagtggatgggctggatcagacccaagaccggcgccagaaaccaggccagacagttccagcccagaatcagcctggccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33954 - RNA, 381 nt, synthetic construct
  misc_feature 1..381: note = derived and/or modified sequence opt4 from anti-HIV-1_HeavyChain
  source 1..381: mol_type = other RNA
caggtgctgctggtgcagagcggcgccgaggtgaagaagcccggcagcagcgtgaaggtgagctgcaaggccagcggcgacagcctgaccaagtacgccttcagctgggtgagacaggcccccggccagggccccgagtggatgggctggatcagacccaagaccggcgccagaaacagagccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33955 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggccagaggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33956 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33957 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggccccggcagcagagtgatcgtgagcagc

SEQ ID NO: 33958 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacatcttcgacgccgcctacatgagatgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33959 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacctggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33960 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcaaggccagcggctacaccttcaccggctactacatgcactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33961 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatcaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33962 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcgtgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33963 - RNA, 381 nt, synthetic construct
  misc_feature 1..381: note = derived and/or modified sequence opt4 from anti-HIV-1_HeavyChain
  source 1..381: mol_type = other RNA
caggcccacctggagcagagcggcagcggcgtgaagaagcccggcgccagcgtgagagtgagctgctggagcagcgaggacatcagcaaggccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33964 - RNA, 381 nt, synthetic construct
  misc_feature 1..381: note = derived and/or modified sequence opt4 from anti-HIV-1_HeavyChain
  source 1..381: mol_type = other RNA
caggtgtacatggaggccggcagaggcggcgtgaagaagcccggcgccagcgccaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33965 - RNA, 381 nt, synthetic construct
  misc_feature 1..381: note = derived and/or modified sequence opt4 from anti-HIV-1_HeavyChain
  source 1..381: mol_type = other RNA
agatgcatctggagacaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33966 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatcaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33967 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgaagagcagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33968 - RNA, 381 nt, synthetic construct
  misc_feature 1..381: note = derived and/or modified sequence opt4 from anti-HIV-1_HeavyChain
  source 1..381: mol_type = other RNA
agatgcctgtggagacaggccggcggcggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33969 - RNA, 381 nt, synthetic construct
  misc_feature 1..381: note = derived and/or modified sequence opt4 from anti-HIV-1_HeavyChain
  source 1..381: mol_type = other RNA
agatgcatctgggagagagccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33970 - RNA, 381 nt, synthetic construct
  misc_feature 1..381: note = derived and/or modified sequence opt4 from anti-HIV-1_HeavyChain
  source 1..381: mol_type = other RNA
caggtgcagctggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33971 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33972 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgagatgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33973 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcagcccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33974 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33975 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgagagtgagctgccaggccagcggctacatcttcaccggctacttcgtgaactggctgagacagctgcccggccagagacccgagtggatgggctggatcagacccaagagcggcgccagaaaccaggccagacagttccagcccagaatcagcctgaccagagacagagccctgagcaccgcctacctggacagcaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33976 - RNA, 381 nt, synthetic construct
  misc_feature 1..381: note = derived and/or modified sequence opt4 from anti-HIV-1_HeavyChain
  source 1..381: mol_type = other RNA
ggctgcatctggacccaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33977 - RNA, 381 nt, synthetic construct
  misc_feature 1..381: note = derived and/or modified sequence opt4 from anti-HIV-1_HeavyChain
  source 1..381: mol_type = other RNA
agatgcatctggagacaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33978 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtgggtgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 33979 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaaggagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 33980 - RNA, 381 nt, synthetic construct
  misc_feature 1..381: note = derived and/or modified sequence opt4 from anti-HIV-1_HeavyChain
  source 1..381: mol_type = other RNA
caggcccacctggagcagagcggcagcggcgtgaagaagcccggcgccagcgtgagagtgagctgctggagcagcgaggacatcttcaagaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33981 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctggatgaagaccgtgaccggcgccgtgaacttcggcagcctggacttcagacacagaatcagcctgaccagagacagagacctgttcaccgcccacatggacatcagaggcctggcccagggcgacaccgccacctacttctgcgccagacagaagttcgagagcagatacaccggcggccagggctggtacttcgacctgtggggcagaggcacccacatcgtggtgagcagc

SEQ ID NO: 33982 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33983 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33984 - RNA, 384 nt, synthetic construct
  misc_feature 1..384: note = derived and/or modified sequence opt4 from anti-HIV-1_HeavyChain
  source 1..384: mol_type = other RNA
agccacacctggaacaacagaggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33985 - RNA, 381 nt, synthetic construct
  misc_feature 1..381: note = derived and/or modified sequence opt4 from anti-HIV-1_HeavyChain
  source 1..381: mol_type = other RNA
cagagccacctggagcagagcggcagcgccatgaagaagcccggcgccagcgtgagagtgagctgctggaccagcgaggacatcttccacaacgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33986 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctggatgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33987 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcggcgaggtgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33988 - RNA, 381 nt, synthetic construct
  misc_feature 1..381: note = derived and/or modified sequence opt4 from anti-HIV-1_HeavyChain
  source 1..381: mol_type = other RNA
caggcccacctggagcagagcggcagcggcgtgaagaagctgggcgccagcgtgagagtgagctgctggaccagcgaggacatcttcgaggacgagctgatccactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33989 - RNA, 381 nt, synthetic construct
  misc_feature 1..381: note = derived and/or modified sequence opt4 from anti-HIV-1_HeavyChain
  source 1..381: mol_type = other RNA
cagagccacctggagcagagcggcagcgccatgaagaagcccggcgccagcgtgagagtgagctgctggaccagcgaggacatcctgaaggccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 33990 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcaaggccagcggctacagcttcaccgactactacatccactggctgagacaggtgcagggccagagacccgagtggatgggctggatcagacccagaaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 33991 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcggcgaggtgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 33992 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33993 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcgccggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33994 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctgggccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 33995 - RNA, 381 nt, synthetic construct
  misc_feature 1..381: note = derived and/or modified sequence opt4 from anti-HIV-1_HeavyChain
  source 1..381: mol_type = other RNA
agatgcagactggtgcagagcggcgccgaggtgaagaagcccggcgccagcgtgagagtgagctgccaggccagcggctacaccttcagcgcctacggcgtgaactgggtgagacaggcccccggccaggagctggagtggatcggctgggtgaagaccgtgaccggcgccgtgaacttcggcagccccaacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33996 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgtgccaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33997 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagatcgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 33998 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcctggaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 33999 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34000 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcgtggtgagcagc

SEQ ID NO: 34001 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34002 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34003 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgagagcagatacaccggcggccagggctggtacttcgacctgtggggcagaggcacccacatcgtggtgagcagc

SEQ ID NO: 34004 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcgccgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagc

SEQ ID NO: 34005 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34006 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccgacttcagacacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34007 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggcagaggcctggagtggatcggctgggtgaagaccgtgagcggcaccgtgaacttcggcagcagcgacttcagaaacagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34008 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34009 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagagacccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34010 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34011 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacttcttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34012 - RNA, 381 nt, synthetic construct
  misc_feature 1..381: note = derived and/or modified sequence opt4 from anti-HIV-1_HeavyChain
  source 1..381: mol_type = other RNA
caggcccacctggagcagagcggcagcggcgtgaagaagcccggcgccagcgtgagagtgagctgctggagcagcgaggacatcttcagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34013 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagc

SEQ ID NO: 34014 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34015 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34016 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34017 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34018 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcggcaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34019 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34020 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgagggcatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34021 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggccagacaggcccccggccagggcctggagtggatcggctgggtgaagaccgtgaccggcgccgtgaacttcggcagccccaacttcagacacagagccagcctgaccagagacagagacctgttcaccgcccacatggacatcagaggcctgaccgagggcgacaccgccacctacttctgcgccagacagaagttcgccagcagatacagcggcgaccagggcagctacttcgacctgtggggcagaggcaccctgatcatcgtgagcagc

SEQ ID NO: 34022 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccgccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34023 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcgagtgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagc

SEQ ID NO: 34024 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctggactgcgtgagcagc

SEQ ID NO: 34025 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcgccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34026 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34027 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34028 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34029 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34030 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34031 - RNA, 384 nt, synthetic construct
  misc_feature 1..384: note = derived and/or modified sequence opt4 from anti-HIV-1_HeavyChain
  source 1..384: mol_type = other RNA
caggccagactggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34032 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34033 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34034 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgccaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34035 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34036 - RNA, 381 nt, synthetic construct
  misc_feature 1..381: note = derived and/or modified sequence opt4 from anti-HIV-1_HeavyChain
  source 1..381: mol_type = other RNA
agatgcatctggagacaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagaggcatcagaatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 34037 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34038 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34039 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcgccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34040 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcgtggtgagcagc

SEQ ID NO: 34041 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcaccagacagaagttcgagagcagatacaccggcggccagggctggtacttcgacctgtggggcagaggcacccacatcgtggtgagcagc

SEQ ID NO: 34042 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggccccgagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34043 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggccccctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34044 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggccccgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34045 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagaggcctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34046 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcatcgtgagcagc

SEQ ID NO: 34047 - RNA, 384 nt, synthetic construct
  misc_feature 1..384: note = derived and/or modified sequence opt4 from anti-HIV-1_HeavyChain
  source 1..384: mol_type = other RNA
cagagccacctggagcacagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34048 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagc

SEQ ID NO: 34049 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34050 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34051 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgaagagacccggcgccagcgtgagagtgagctgctggaccagcgaggacatcttcgagagaaccgagctgatctactgggtgagacaggcccccggccagggcctggagtggatcggctgggtgaagaccgtgagcggcgccgtgaacttcggcagccaggacttcagagacagattcagcctgaccagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34052 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34053 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34054 - RNA, 384 nt, synthetic construct
  misc_feature 1..384: note = derived and/or modified sequence opt4 from anti-HIV-1_HeavyChain
  source 1..384: mol_type = other RNA
cagagccacctgaagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34055 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34056 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagc

SEQ ID NO: 34057 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34058 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcctggagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34059 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcgtggtgagcagc

SEQ ID NO: 34060 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34061 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgacgacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34062 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34063 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34064 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgaagagacccggcgccagcgtgagagtgagctgctggaccagcgaggacatcttcgagagaaccgagctgatctactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34065 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagagacagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34066 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34067 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34068 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagccccaccagagacagagacctgttcaccgcccacatggacatcagaggcctgacccagggcgacaccgccacctacttctgcgccagacagaagttcgagagcagatacaccggcggccagggctggtacttcgacctgtggggcagaggcaccctgatcgtggtgagcagc

SEQ ID NO: 34069 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgcccaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34070 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgccagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34071 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34072 - RNA, 384 nt, synthetic construct
  misc_feature 1..384: note = derived and/or modified sequence opt4 from anti-HIV-1_HeavyChain
  source 1..384: mol_type = other RNA
caggtgcagctggtgcagagcggcgccgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34073 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34074 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34075 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagc

SEQ ID NO: 34076 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcgtggtgagcagc

SEQ ID NO: 34077 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34078 - RNA, 381 nt, synthetic construct
  misc_feature 1..381: note = derived and/or modified sequence opt4 from anti-HIV-1_HeavyChain
  source 1..381: mol_type = other RNA
caggcccacctggagcagagcggcagcggcgtgaagaagcccggcgccagcgtgagagtgagctgctggaccagcgaggacatcctgagaaagagcgagctgatccactgggtgagacaggcccccggccagggcctggagtggatcggctgggtgaagaccgtgaccggcgccgtgaacttcggccaccagatcagcgacagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34079 - RNA, 384 nt, synthetic construct
  misc_feature 1..384: note = derived and/or modified sequence opt4 from anti-HIV-1_HeavyChain
  source 1..384: mol_type = other RNA
cccgcccacctggagcagagcggcagcggcgtgaagaagcccggcgccagcgtgagagtgagctgctgggccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34080 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgagcggcgccgtgaacttcggcagcaccgacttcagagagagaatcagcctgagcagagacagagacctgagcaccgcctacatggacatcagaggcctgacccaggacgacgccgccacctacttctgcgccagacagaagttcgccagcagatacagcggcgaccagggcagctacttcgacctgtggggcagaggcaccctgatcgtggtgagcagc

SEQ ID NO: 34081 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacctgagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34082 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcaccctgatcgtggtgagcagc

SEQ ID NO: 34083 - RNA, 384 nt, synthetic construct
  misc_feature 1..384: note = derived and/or modified sequence opt4 from anti-HIV-1_HeavyChain
  source 1..384: mol_type = other RNA
agccacgacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34084 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34085 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcgtggtgagcagc

SEQ ID NO: 34086 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcccacatgggcatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34087 - RNA, 384 nt, synthetic construct
  misc_feature 1..384: note = derived and/or modified sequence opt4 from anti-HIV-1_HeavyChain
  source 1..384: mol_type = other RNA
gaggtgcagctggtgcagagcggcgccgacgtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34088 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgcaccaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34089 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagccctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34090 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34091 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34092 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34093 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctgggctggatcggctgggtgaagatcgtgagcggcaccgtgaacttcgccagcctggacttcagaagcagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34094 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggccaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34095 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34096 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34097 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34098 - RNA, 384 nt, synthetic construct
  misc_feature 1..384: note = derived and/or modified sequence opt4 from anti-HIV-1_HeavyChain
  source 1..384: mol_type = other RNA
agccacaacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34099 - RNA, 384 nt, synthetic construct
  misc_feature 1..384: note = derived and/or modified sequence opt4 from anti-HIV-1_HeavyChain
  source 1..384: mol_type = other RNA
agccacacctggaacaacagaggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34100 - RNA, 384 nt, synthetic construct
  misc_feature 1..384: note = derived and/or modified sequence opt4 from anti-HIV-1_HeavyChain
  source 1..384: mol_type = other RNA
agccacacctggaacgagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34101 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctgaacttcagaagcagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34102 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgaaggtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34103 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34104 - RNA, 384 nt, synthetic construct
  misc_feature 1..384: note = derived and/or modified sequence opt4 from anti-HIV-1_HeavyChain
  source 1..384: mol_type = other RNA
ggccacgacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34105 - RNA, 384 nt, synthetic construct
  misc_feature 1..384: note = derived and/or modified sequence opt4 from anti-HIV-1_HeavyChain
  source 1..384: mol_type = other RNA
agccacacctggaacaacagaggcagcgccatgaagaagcccggcgccagcgtgagagtgagctgctggaccagcgaggacatcttcgacaccaccgagctgatctactgggtgagacaggcccccggccagggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34106 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34107 - RNA, 384 nt, synthetic construct
  misc_feature 1..384: note = derived and/or modified sequence opt4 from anti-HIV-1_HeavyChain
  source 1..384: mol_type = other RNA
agccacacctggaacaacagaggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34108 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgcctggccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34109 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcgccgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34110 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34111 - RNA, 384 nt, synthetic construct
  misc_feature 1..384: note = derived and/or modified sequence opt4 from anti-HIV-1_HeavyChain
  source 1..384: mol_type = other RNA
agccacacctggaacgagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34112 - RNA, 384 nt, synthetic construct
  misc_feature 1..384: note = derived and/or modified sequence opt4 from anti-HIV-1_HeavyChain
  source 1..384: mol_type = other RNA
agacacacctggaacgagagcggcagcggcgtgaagaagcccggcgccagcgtgagagtgagctgctggagcagcgaggacatcttcgagagaaccgagctgatccactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34113 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgagatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34114 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagc

SEQ ID NO: 34115 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccagatcttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34116 - RNA, 384 nt, synthetic construct
  misc_feature 1..384: note = derived and/or modified sequence opt4 from anti-HIV-1_HeavyChain
  source 1..384: mol_type = other RNA
agccacacctggaacaagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34117 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagccagatcttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggccccaccctgttcgtgagcagc

SEQ ID NO: 34118 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagacctgcagcggcgccgtgaacttcggcagcgtggacttcagagacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34119 - RNA, 384 nt, synthetic construct
  misc_feature 1..384: note = derived and/or modified sequence opt4 from anti-HIV-1_HeavyChain
  source 1..384: mol_type = other RNA
agccacaccgtggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34120 - RNA, 384 nt, synthetic construct
  misc_feature 1..384: note = derived and/or modified sequence opt4 from anti-HIV-1_HeavyChain
  source 1..384: mol_type = other RNA
agacacacctggaacaagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34121 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagagactggagtggatcggctgggtgaagaccgtgaccggcgccgtgaacttcggcagccccaacttcagacacagagtgagcctgaccagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34122 - RNA, 384 nt, synthetic construct
  misc_feature 1..384: note = derived and/or modified sequence opt4 from anti-HIV-1_HeavyChain
  source 1..384: mol_type = other RNA
agccacgacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagc

SEQ ID NO: 34123 - RNA, 384 nt, synthetic construct
  misc_feature 1..384: note = derived and/or modified sequence opt4 from anti-HIV-1_HeavyChain
  source 1..384: mol_type = other RNA
agacacacctggaacgagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccaccacctacttctgcgccagacagaagttcgagagcagatacaccggcggccagggctggtacttcgacctgtggggcagaggcacccacatcgtggtgagcagc

SEQ ID NO: 34124 - RNA, 384 nt, synthetic construct
  misc_feature 1..384: note = derived and/or modified sequence opt4 from anti-HIV-1_HeavyChain
  source 1..384: mol_type = other RNA
agacacacctgggagcaggtgtggagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34125 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgaccgtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34126 - RNA, 384 nt, synthetic construct
  misc_feature 1..384: note = derived and/or modified sequence opt4 from anti-HIV-1_HeavyChain
  source 1..384: mol_type = other RNA
agacacgacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34127 - RNA, 384 nt, synthetic construct
  misc_feature 1..384: note = derived and/or modified sequence opt4 from anti-HIV-1_HeavyChain
  source 1..384: mol_type = other RNA
gtgaccacctggaacaagagcggcagcgccatgaagaagcccggcgccagcgtgagagtgagctgctggaccagcgaggacatcttcgacaccaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34128 - RNA, 384 nt, synthetic construct
  misc_feature 1..384: note = derived and/or modified sequence opt4 from anti-HIV-1_HeavyChain
  source 1..384: mol_type = other RNA
agacacacctggaacaacaccggcagcggcgtgaagaagcccggcgccagcgtgagagtgagctgcctggccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34129 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgcctggccagcgaggacatcttcgagagaaccgagctgatctactgggtgagacaggcccccggcagaggccccgagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34130 - RNA, 384 nt, synthetic construct
  misc_feature 1..384: note = derived and/or modified sequence opt4 from anti-HIV-1_HeavyChain
  source 1..384: mol_type = other RNA
agacacacctggaacaacaccggcagcggcgtgaagaagcccggcgccagcgtgagagtgagctgctggaccagcgacgacatcttcgagagaaccgagctgatccactgggtgagacaggcccccggccagggcctggagtggatcggctgggtgaagaccgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34131 - RNA, 384 nt, synthetic construct
  misc_feature 1..384: note = derived and/or modified sequence opt4 from anti-HIV-1_HeavyChain
  source 1..384: mol_type = other RNA
ggcacccccggcaacaagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34132 - RNA, 384 nt, synthetic construct
  misc_feature 1..384: note = derived and/or modified sequence opt4 from anti-HIV-1_HeavyChain
  source 1..384: mol_type = other RNA
ggcacccccggcagcgagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34133 - RNA, 384 nt, synthetic construct
  misc_feature 1..384: note = derived and/or modified sequence opt4 from anti-HIV-1_HeavyChain
  source 1..384: mol_type = other RNA
gtgacccccggcaccaacctgggcctgagaatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34134 - RNA, 384 nt, synthetic construct
  misc_feature 1..384: note = derived and/or modified sequence opt4 from anti-HIV-1_HeavyChain
  source 1..384: mol_type = other RNA
agacacgacctggagcagagcggcgccggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34135 - RNA, 384 nt, synthetic construct
  misc_feature 1..384: note = derived and/or modified sequence opt4 from anti-HIV-1_HeavyChain
  source 1..384: mol_type = other RNA
caggtgcacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgacccccgacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34136 - RNA, 384 nt, synthetic construct
  misc_feature 1..384: note = derived and/or modified sequence opt4 from anti-HIV-1_HeavyChain
  source 1..384: mol_type = other RNA
ggcaccacctgggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34137 - RNA, 384 nt, synthetic construct
  misc_feature 1..384: note = derived and/or modified sequence opt4 from anti-HIV-1_HeavyChain
  source 1..384: mol_type = other RNA
agccacgacctggagcagagcggcagcgagtggaagaagcccggcgccagcgtgagagtgagctgctggaccagcgaggacatcttcgacaccaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34138 - RNA, 384 nt, synthetic construct
  misc_feature 1..384: note = derived and/or modified sequence opt4 from anti-HIV-1_HeavyChain
  source 1..384: mol_type = other RNA
cagagcagacccggcaacaagagcggcagcgccatgaagaagcccggcgccagcgtgagagtgagctgctggaccagcgaggacatcttcgagagaaccgagctgctgtgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagc

SEQ ID NO: 34139 - RNA, 384 nt, synthetic construct
  misc_feature 1..384: note = derived and/or modified sequence opt4 from anti-HIV-1_HeavyChain
  source 1..384: mol_type = other RNA
ggcaccacctggagcaagagcggcagcggcgtgaagaagcccggcgccagcgtgagagtgagctgctggaccagcgaggacatcttcgagagaaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34140 - RNA, 387 nt, synthetic construct
  misc_feature 1..387: note = derived and/or modified sequence opt4 from anti-HIV-1_HeavyChain
  source 1..387: mol_type = other RNA
caggcccacctggagcagagcggcagcggcgtgaagaagcccggcgccagcgtgagagtgagctgctggaccagcgaggacatcctgagaaagaagagagtggacagcgtgggctgcgacaccgcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34141 - RNA, 387 nt, synthetic construct
  misc_feature 1..387: note = derived and/or modified sequence opt4 from anti-HIV-1_HeavyChain
  source 1..387: mol_type = other RNA
aaggcccacctgggcaacaagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34142 - RNA, 384 nt, synthetic construct
  misc_feature 1..384: note = derived and/or modified sequence opt4 from anti-HIV-1_HeavyChain
  source 1..384: mol_type = other RNA
accaccgtgggcaccatcctgggcagagccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34143 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgaaggtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34144 - RNA, 387 nt, synthetic construct
  misc_feature 1..387: note = derived and/or modified sequence opt4 from anti-HIV-1_HeavyChain
  source 1..387: mol_type = other RNA
cagagccacctggagcaggtgtgggtgtgccagagcaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34145 - RNA, 384 nt, synthetic construct
  misc_feature 1..384: note = derived and/or modified sequence opt4 from anti-HIV-1_HeavyChain
  source 1..384: mol_type = other RNA
agacacaccgtggagcagagcggcagcggcgtgaagaagcccggcgccagcgtgagagtgagctgctggagcagcgaggacatcttcgagagaaccgagctgatccactgggtgagacaggcccccggccagggcctggagtggatgggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34146 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgcagcgccagagaggacatcttcgacaccaccgagctgatctactgggtgagacaggcccccggccagggcctggagtggatcggctgggtgaagatcgtgtgcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34147 - RNA, 387 nt, synthetic construct
  misc_feature 1..387: note = derived and/or modified sequence opt4 from anti-HIV-1_HeavyChain
  source 1..387: mol_type = other RNA
gaggtgcagagaggcggcagagtggtgggcagagacgtgaagaagcccggcgccagcgtgagagtgagctgctggaccagcgaggacatcttccacaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34148 - RNA, 384 nt, synthetic construct
  misc_feature 1..384: note = derived and/or modified sequence opt4 from anti-HIV-1_HeavyChain
  source 1..384: mol_type = other RNA
ggcaccacctggaacgagagcggcagcggcgtgaagaagcccggcgccagcgtgagagtgccctgctggagcagcgaggacatcttcgagagaaccgagctgatccacagagtgagacaggcccccggccagggcctggagtggatcggctgggtgaagaccgtgaccggcgccgtgaacttcggcagccccaacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34149 - RNA, 384 nt, synthetic construct
  misc_feature 1..384: note = derived and/or modified sequence opt4 from anti-HIV-1_HeavyChain
  source 1..384: mol_type = other RNA
agaagcaactgggtgcagagcggcgccgacgtgaagaagcccggcgccagcgtgaagagcagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34150 - RNA, 384 nt, synthetic construct
  misc_feature 1..384: note = derived and/or modified sequence opt4 from anti-HIV-1_HeavyChain
  source 1..384: mol_type = other RNA
cccgtgcagctggtgcagagcggcgccgaggtgaagaagcccggcgccagcgtgaaggtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34151 - RNA, 399 nt, synthetic construct
  misc_feature 1..399: note = derived and/or modified sequence opt4 from anti-HIV-1_HeavyChain
  source 1..399: mol_type = other RNA
agagagtacctggagcagagcggcggcggcgtgaagaagctgggcgccagcgtgagagtgagctgcagagccagcgaggacctgttcggcgacgaggccatctacgacgacgagctgatccactggctgagacaggtgcccggccagagacccgagtggatgggctggatcagacccaagaccggcgccagaaaccaggccagacagttccagcccagaatcaacctgagcagagacagagccctgaacaccgcctacctggacctgagcagcctgaccagcgccgacagcgccacctacttctgcgccagacagaccttcaagcccgacttctacttcgccgaccagggctggagcttcaacctgtggggcagaggcgccagagtgatcgtgagcagc
